United States Patent 11,690,879 (DYSOSMOBACTER, A NOVEL BACTERIAL GENUS OF THE GASTROINTESTINAL MICROBIOTA AND USES THEREOF) - sequence listing, part 2

SEQ ID NO: 10 - DNA, 3576111 bp, Dysosmobacter welbionis (residues 1,788,057-3,576,111 of 3,576,111)
  genome strain J115 (circular)
ggtctggcccttggcggcgtcggaaccggcgtcggattcggtcaggcagaaggcgccgaccttgtggcccttggtcagcatgggcaggtacttggccttctgggcctcggtgccgtgggtgatgatgggatcgcagcacaggccgttgtgggtggccacgatgtcgccggtggaggcgcactgcttggacagctcctcgatgcagatggcactggccagggggtcagcgccagcgccgccatactccttggggacgcacatgcccatcacgcccaggttgaacagcttctcgatgttctcccggggatactggctggtcttgtcggtctcggcagcgatgggcttcacttcattctcggtgaattccgccatcatcttccggaccagctggtgctcacggctgagattgaaatccatgatgtcttctccttatattcaaatttggaaaacgcaacgatgtatgaaatattccggcaggtttgcttatgaaattctgttttgcacgaattcacttcgggcaaaacacctctgcccgccgggtcgacatgttcgctgtgcgaacgtgagggggaaaccggcgatgcgccgccagcggcagagcaagcgagccggtttcgaggcagcggcgcgcttggcggcccgtcaggggccggggatcgcaatgccgcaacagtgggaccttagttctggatgccggcgatctccttggccatctgcttcttggcctggaggttgccctggcgggcgatcatgatgcgctgggcctggggagagcccgcgccgtgcatggactctgtccggtagccaacggcggccgcgcccaggcacaggttctcgatgaaccgcaggatccgctgacggtcctctgtgctcacaccctcccgggtggcgaagaacttgttgcagatctccccgatggtctcgccgttccggcccaccaccgtgtcggagtggaagtccttctgggacggcatcgtcaccaccaggccgcccgcgatgtcctccgccaggcggacgatctcataggggaaccgagtcacattctgcttgcacacgttggccagcagcaggtcgatctgatagttgcccgccttcgtccggaagccctgagaggagcaggcgatgccgcagcagtacagcgtctcgttcaggtggatcatctcgatcagcttgtccttcaccgcgctggccttctccacgccgttgtactccgctgccagcgccgcagcaccgatcagcgtgtcgcccacgcccaccttgcagccgccgtagctctgccggtggtagcccgcgaaccgctccaccatcatgccggcgaactcatactcgccgttgaggaagatgtactcgttggggatgaacacgtggtccagcaccaccagggcctcctggccgccgaacttcgcgttgcccacgtcgatggacgcgtcctcctccagcttccgggtatcgcagctctgacggccgtagatcatgtacatgccctcggcgtctgtcgggcaggcgaagctcaccgcccagtccttgtccgcctcgcccatggagatggtgggcatgaagatgtgccagtggctgttgatggagccggtctggtggcacttggcgccgcagaccacgatgccgtcagcgcggcgctccaccacatgcacgtacatgtccgggtccgcctgctggctgggggccttggaccggtcgcccttggggtcggtcatggcgccgtccaccgtcaggtcgttgtcctggacgaaggtcaggaacttcttgaagttttcgtgatagcgggtgccgtacttctcgtcgatctcataggtggtggagaacacggcgttgaacgcatccatacccacacaccgctggaagcaggaagcggtcttctggcccagcaggcgctgcatcttcaccttgttgatgaggtcctccgtggactggtgcaggtgggtgaagcggttgatggtgtggcccgtcaggctggacttcaccgtcatcaggtcggcatactgcgggtcctgggccagagcgtaggtcatggccacgcagttgatggacgggcggatcatggggtggtccacccagttctcaatcttctccccgaacatatacacccgggtattcagtttgcgcaggctctctacatactcctgtgcggtcatcaatgccatttcttttttcctcctcaaaaaaatgggggtcttttacatttcaatgtgttccaggtgagcttcgcctgcccggaactccatggcccgcgccactgggcgcggctccctcgccgtgtgagggagagggggaacccggctcgcttgatccgccgctggcggcgcttcgccggtttcgaggcagcggcgcgatttgcggcccggtcagggctggaaatcgcattgctgcgacggtggaaattctcaggcttccgccagtcccatcagctcatctttgaagatgcgctcgtccataagcttcaggtcctcagcgatcttcggcatgaactccatctgatccagcacctgggtctggaggtcgatgcccggcgcgatctcgatcagagtcacgccctcgggccgcagctcgaacacagcccgctcggtgatgtacagaacaggctgcttcacctgcacggcatacttgccggagaaggtgatgtgctccacctggttgacgaacttcttcttggcgccctcctggacgatcaccagcttgccgtcctcgcaggcagtcttcaggcccttggcggtgaaggtgccgcaatagaccaccttcttggcattctgcgtaatgtcgatgaagccgccggcgccagccagacgggtgccgaacttggacacgttcaggtcgccgttgggtgccgtctccgccaggcccaggaaggccacatccaggccgccgccctggtagaagtcaaactggacgttgtgggggatgatggccatggagttggctgcggcgccgaactgggtgccgcccatgggcacgccggcgatggagccggcctccacagtcagggtcatcttgtcggagatgccctcctccgccgccacgttggcaattttttccggcgcgccggtgcccaggttcacaatggcatcctggggcagctccatggcggcccggcgggcgatgatcttcttggcgtccagcgggatgggtgggatggcgtccacgggaatgcggaactcgccggtcaggctgccgtcatagggcattcccaggcactgctcgttatcctcaatggatcctaccacaatagaatccacatagataccgggaattgccaccagtttcggatccaggctgccgccttggacgattttttccacctggacgatgacccggccgccggagttcttgcaggcctgagccatggcggtgacgtcgatggggccgatctcccggtgaacggtgcagttgccgtactcgtcggcgtagctggcacgcaggaacaccacattgatggggaacgccttgtagagcaaccgctcctggccctcgatctcgacgaccttcaccaggtcctccttggtgacatcgttgagtttgccgccgccgttgcgggggtcggcaaaggtgtacaggcccacgtgggtgatggtgccgatgttgtgggccgcgatgtcccggtacatgtgggagatgacgccctggggcaggttatacgcctcgatcttgttgctcagggccagatcgcccagcttgggggcccggtcccagtggccgccgatgacccgcttgaccatgccctcgtggccgtagtggtcgccgccggtgccgtcccggtggccctggcctgccgcgaagaacagcgtcagatctctgggatggcccgtctccaggaaccgcttctccaatgccttggacagcgcctcagggcaggcgcagctgacaaagccgccggtggcgatggtatcgccgtcgttcaccagcagcgccgcctcctcggcggtaagcacgcgaacttttttcatgcctgacttccctctttatatgtaatgaaatggacggcctcttgccggtctgcgctcacttgttctggaagtgcttctccttgcgcttctccaggaaggcgcccatgccctccttctggtcctcggtggcaaagcacatggcgaacagctcgttctccagggcgatgccgttgtcgatgtccatctgcatcccgcggtcgatgcaggccttggaatacttcacagcgatgggggcgttggcggtgaaggacttggccatctccacagccttgttcagcagctcctcggcggcatagacctcattcaccaggccgatgcgcttggcctcctcagcaccgatctgcttgccggagaagatcaactccttggccttggccacgcccacacggcggggcagacgctgggtgccggagaagccgggggtgatgcccaggcccacctcgggctggccgaacttggcgccgcccttgccctcagcgttggggccggcggccagaatgatgtcgcaggacatggccagctcacagccgccgcccagagcgaagccgttcactgcggcgatggtggggatctccagcttctcgatccggcggaacagggcgctgccccgctggccccacttgcggccggcggccacgtccatggtgctctgctcgccgatgtcggcgccggccacgaaggagcggccctcgccggtgatgatgaaggcgcccagctcggcatccttctccacctcgctgatgagctgttccagctcagagatcacggtggagttcagcgcattcagcgcctcggggcggttgatggtggcgatcccgatattgccgttcttttcatagcgaatggtctgatacatattggaatgtcctccttaatcatattttgctcagcaaactgttggagagtaatcatccaacaatttagttatagcaaaaatcatgccatttttccaggtgtaattctctcattttcggttcgtttttttgtgtaggttgctaaaatccaagtggtaaatcgcttgcttttcccggtgccgtcagccgtttccatacgggattattcatttttgaataacaaatttatcagtgtcttccagcattttccgcagtttgtttgtgaaatacagcagtctgtctgtcgaattttcgtgaaatttcacgagccaaaaatatttcccgcctcttcctattcatttttgaatatgctatactcatttttgaatagagcaaccggcattcagtccggcacaggaggtctgcgcctatggcgattccgtctttttctgctttccacgacgaggggatcaatctggagggacttctggagatcctcagcccggaaaacaacttggtcctggcggacgacatgatggtctcggacggcaacggcatcattctgcgggtcagcgagacctatgagaaaaacttcggttttgcccatgactccatcgttggcaagtccgcctttgatctggaggcggacggcaccttcaccccctgcattacggcggaggtcatccggcgacggaagaagatcagcgccacacagaccatcaaccacacccacaaaaacgtgatgaccgtgggcattcccctgtttgacgccaacggggagctgaaatacgccgtctgcttcaacaccgtgtccatggagcagatcaactccatccaacggaactaccgccggatacaggactccctgcagcactactcccaggagattgccgagctgcggacccgggccacctccaccaatctgctgttcaaaagcgcccccatgcagcggctgtggacgctgatgcagaacactgccaacacccgggccaacattctcatcaccggagagaccggcgtgggtaaaagcgccatcgccaaggccattcacaagatgagcaaccgtgcaaacgggccctttatcgaggtaaactgcgcggtgctccatgaaaatctcattgagtcagagctgttcggctatgagaagggcgccttcaccggggcctcctcctccggcaagatcggcaagatcgagctggccaaccacggcacgctgttcctggatgagatcggtgagctgcccgcccatatccagtccaagctcctgcagctgattcaggagaagaccattgagcgcctctccggcacccagaagatcgagctggacttccggctgatcgttgccaccaaccgcaatctggaggaggcggtgcagcgcggtctgttccggtccgatctcttctaccggctgaacgtcatccgcatccacatccccccctgcggcagcggaaggaggacatcgtccccatggcccaccagttcctggcccgcttctgcggggagtacaacaagtccctcacctgcagcccccgctttctggcttttctggagcagtacgattggcccggcaacgtgcgccagctggagaacctgatggagcggctggtaatcactgcccaggaccccattctggacattcctgccctgccgctggagtacaccgccgacgcgtcggcccctgcggagctgcttcccggcggcacgctggcagagcggatggacgcctacgaggcccaaatcatccgggattcctaccagcggtgcggcaccacagtggccgtggcccgggagctgggcatctcccaggccacagcagcccgcaagattgccaaatacgtgaccgcccgggcgtgagaggaggttccggtccatgagtttgatccatctcagcacagagcttcggcaggagctgaagctcaccccccagctcctgcagtccatggagcttctgcagatgaactcccaggagctgctggactatctgaaccaggtcagcgaagaaaaccctctggtggagcagactgatctgtcctccctccacaaagcctatgaggccctgcggcagaaggtccactggatcaatggcggcctgccggaggacggccacggcgccatgccggaccggggcgccgcggaccgggagacggagagcctctccgccttcctttgcgaccagctggagcgccggcgcctgcccaagcccctgctggccctgacccggtatctggcagagctggtggacgaggagggccgcctcagccaggaggacctggacggcgtggcagatctgaagatcccccaggccctgacccagcaagcgctggagaccctccagagcctggaccccgccggcgtgggcgcccggtccctgtcggagtgcctgctgctgcaactggcccggcaggatgctccctcccccctggatatggagatcgtccgccgcttcctgccggacttgggcaagaagcattacagcctcattgcccgggaactccataccacgccagaggaggtccgggcggcggaaaagcggatctctgccctggatccctgccccggccgctccttccagccggcggagcccacactctatgtccggccggatctgttcatcgcggaactggacggaaagctccaggtgatcctgaacgattactaccttccccgggtgtccatcagccagtactatgtgcggcttctgaaggaatccgacgagccggagacccgggcctatctccagcaaaagatgcagcaggccaagtggctgctgaacagcctggagcgccggggcagcaccctccgccagtgcgcggaggcgatcctggagacccagcgggccttttttgccggccagaccacagagctggtccccatgaccatggtgacactggcggagcgactccacctccatccctccaccgtctcccgggccactcgggagaaatacctccagtgccggcaggggacgtaccccctccgctatttcttcagccgcgctctgggggagcagggtccctcccagcagacggtgaagctgcggctgctggagctgatccggcaggaagaccacagccgcccgctcagtgaccagaagctggcggagctgctggcggagcagggcatccgcatcgcccgccgcacggtggccaagtatcggacggagctccgcctgggctccgccgccgcccgaaaacgggactgagggcctactggcccgcagaggcccgcaggatagaaacggaagccccggacggagtttcgtccggggcttccgtgtttttccgatttacaggatccgaaggacctcttcatatcccggcaccgcatccgccgcgccgggccgggacacagccagggcgctggccgccgcggccagggacagtgcctcttccagtgtgccgccctccagcgcccggcgcaggaagtagccggtgaaggtgtctcccgccgcagtggtgtccaccaccgccgttttccgggctgggccccaggcccgccagccccctcgcgctgcagcagcgccctgttctcccaaggtcagcaccacagtggtctccgggtaccgcgccgccagcgtgtccagaatcgcctccggcgcctccgttcccgccagaaaggcgccctccacctcgttcaccaacagccaggacagcgcctccagcggcaggcccaccagcttctcattggcgggagccgcattcatggccgtccgcatcccccggcgggccgcctggtggatgatttcctccacgcagctggtctcattctgcagcagcaccgtgtccccggctgagaactgatccagcaccgccgtcacaaagtccggggtcaggcggccgttggccccgtcgtggagcaggatgctgttctggccggtgctgtccacttggatgatggcgtggccggtactgcctgcggactcctccacaaaccgggtgtggacgcctgcccggtccagcgtctccttcagaaaatgcccctccggcccgatgaggcccgcgtgccaggtctccaccccggcccgagccagagccacggactggttcagccccttgccgccgcactggatctgcagggactgggcgctcatggtctctccgggctggacgaagtggtccacccggtagacgtagtcgatattcagggacccgaagttgacaacgcgcatatccttctcctccctcatgccataaaggtggtgagcagctcttccagggcgcggcggctgtccacatccacgcagatggagacgccgggagcctcgatgggatgctcccgcagatccgccaccaccatgccccggcagaagctgccgccgcactccacccgggcggggatggtccgcaccgtcaccacactgggatccaccgccgccagcatggccagcgggtcgtggaccgggcagtggtccagacagttgttttgcagtcggttgaaccggaagtagaagggcagtgcctgcttcagatagtccacaatgggccggttctccggcgcggcgtacttgtccaggatcgccacatggtccgtggtcagccgcaccttctgggtcacatccagccccaccatagtcaggtcaaagcccgcctggaacacccggtccgccgcctccgggtcccctgcgatgttggcctccgctaccggggacacgtttcccggcgcgtggaacgtgccgcccatgaacaccacccgtttcaacagccggggcagatccggctctatctccagagcctttgccagattcgtcattcgggccagcgtcaccaaggtcagctcgccggggtgctcccgggccattcgggcgatgaacgcccaggccggttcctccagcggctgctggggcgaaggcggcagctccaccccgccgatgccgttgggcccgtggatgtggggatccggccccttccagttccccgccagcggctccgtggctccaaccgccaccggcacctcataaggcacaccggccagtcggatcagccgcagactgttttccgccgcctgccgggctgtggtgttgccgaagccggtggtgacgcccatcacccggacgtccggccgcttcagggcaaacagaatggcgatggaatcatcaatgccggtgtcggcgtcgatcaggatctgcttcagcatattccttcctccctgtttatgtagtctctccgccgtctttggcggcggcaatccggacccccagaccgttgacctccacactctcgtccgccgggaccagcaggtagcgccgtccgtcgatgatccgggcctccaccagatagctccgctccgggtccacctggatagtggcgtcggcggtcttgaccgcgaagtgcttggcgtcgatcaggttggccggggtcagcgccccctcgccaaaggactggccgcaggcggtttggaacgcctccacccgctcctccggcacgccgcagttccgcagcacgccgctcacctcgcctgcggtgacagccagcggctccgggtcccggctctccttgtgttcctggatccgctggcgcaggtagtcgtggacagactgcaccacctccatgctgcacgccccctccagagtgccgcacagggcggactgaaaggtctcccgctgctcggcggcggacatgggcggctctgtgcggaacactgcgtcaatgaactcctgatggagctcgtccggcttccggctgtaaaacagggcgttgtaaaggttggccgtccggtcatcaaaggccgggaacaaaaagccaagctccggctggcccacgatctgcttctccatagagatgtggaactcgttctccccatggaagtatcccagctccggcgtcccatccttcaccgggcagacgcagcagacgaagtagcggaacacctcttcgcaggcatcccggtccacctcgccgtccttgccccggtggggcacatcataggcgtcggcccccagcaggatcagatagttgttctcccccatgtccagggagccggtgacctgctggtaaaaggcatcccgggcctccgcgtccttcagctcggacgtccgcagggcggagagcaggcggtgctcctcgctgtccgccacctgctgggtggaaaacacgatgtcaatcaggttccggcccagggtgccggacagggcctttttcagcaggcccaggtatttttccgcctcctcctggggcatgaggcctagggactggtcgatataggcgatgatctcgcggctgctgttcacatagcagccgtaaacacggctgatggcgctcttctccggccggaaccggcggcgcagctcacccagctctctttggttcatgggggacacctcgctcgttcaaattgatcccagcgggaccgcagtcctgccgggtctctatcttagcacatctccgccgtcttgtcacgccgaaaggggcggacaggaaaaacggcgggaaccgcagtccccgccgtttcacgtttcaaatgcgctccaaaggatgtccgcttactgggcagccatcttccgggccctggcctcagccttgttccggaacacgtcgatggtgaccgccagaatgatgacggcgccgatgacgatgtactgaatgtcgttggaggcgcccatcaggttcaggccgttgcggatgaccgccatcagcagggcgccgatcagggtgccccagatggtgcccttgccgccggtgaaggaggcgccaccgatgatgcaggccgcgatggcatcagtatcataggtggagccggcattgccgttggcagaagccagacgacccacggacaccacgcccgccatgccggccatgaagccggacagggagtagacgaaggtcagcacgttcttggaggggataccggagaggcgcgccgcctcggggttgccgcccacgcagtagatctggcggcccagggcggaccgggtcaggaacacgtggaagatgccgaacacgatcagcaccaggatgaagctgaaggggatgccggggaaggtctcggtcttgaaaagggagccgccgccgatccacatcaggttgtccacgccggtgttggtaaaggcaatggatttcgaccctgtaatcaccagggccaggccccacagcacgttcttcatgcccaaggtggacacgaagggatggggcaggtccaaacgggtcagcagaatgccgttgacaaagccggcaaacgtgctcaccgccaggccggcgatgatcagcagcggcatgctggtgatgccgaagttctggaccagcacgccgatggtgcaggtgcacagcacgcagttggaacccacggacaggtcgatgccggcggtaatcagggcgcacagcatgccggaggcgatcaggcagttgatggaagcctgcttgaagatgttcatgatattgctgatccgcgggaatttatcgggcatcatcacgcagaaaatgagaaccagcagcgccagcgccatcagggtgccgagcttttgcaaaagctcttttccggaattcttctttttcatatcagtctaattctcctccccaggccgctttcatgatatcctcagagttgaagtgcggggtatcacggtcgatattggccatgacccggccgccccgcatgaccaccacgtggtcactcatggccaggatctccggaagctcggaggagaccatgatcacacacttgccggccttgaccaggtcattcatgacatggtagacctcgatcttggcgcccacgtcgatgccgcgggtgggctcgtcgaaaatgaagatgtccgcgtcggtgttgacccacttgccgataaccaccttctgctggttgccgccggagagctgggccgtcacctcgtccagggacggagtcttgatccgcagggactccacattgtcctggccggacttctcaatcttccccttgttcaggaagggtccgttggagaagcccttcatattggccagaatgaggttggtccgcacgtccagggacagcaccagaccctggcccttgcggtcctcggtcaggaaggcaatcttcttcttgatggcgtccttgggcgtccggatatgtaccttctcccccttgacgtagatctcgccgctgtccaacctgtcggcgccgaagatggcccgcatggtctccgtccgcccggcgcccaccaggccagcaaagccggtgatctggccgccgtaggccttgaagctcacgtcatggaggacgccggcctcgttgaggttcctggcctccagccacacgtcgcccttgacgccgaactctttgggatacaggttgtccagcgtccggcccaccatggcgttgatcagggagtcctccgtcatgtcaccgatgtcctgggtgacgatatgttcgccgtcccgcatgacggtgacccggtcgcagagctcgaacagctcttccaatttatgagagacgaacaggatggccacgcccttggccttcaggccccggaccgtctccatcagctggttgatctcctccttgcccagggaggaagtcggctcgtccatgataatcagcttggcgtccagcgacacagccttggcgatctccaccatctgctgctggccggtacccagcttgccgcattccattttaacatcaatttcgggatggcccagcgtggtcagggcctgcttggcttcctcgtacattctggggtagtccagaaggccgtttttcttgacggcgcgtcccatgaaaacgttatccgtgacagacagctgcttgacgatgttcagctcctggtacacgcaggcaatgcccgcctcgcgggactggacggggttgtggaagacgaccttctggccgtccacgtagatctccccctcctcaggagtgtgaacgccggtgagcaccttaatcaaggtggacttgccggcgccattttcgccgatcaggccgtggatctctcccggccggatgccaatagacatatttttcaatgcgacgacaccaggaaaacgtttggtaatgttcttcaactcgacaacatactcgctcatgggattacctcgtttctgtttcctgatttcagcggtccccgccgcccgcggggaggtgcggaacgggaatatggcggcaggaccactgccgccatattccattcattcagatgtgagatctgaggggcacaggctgatcagccctgcatggcagccaggctatccaggtactcctggccgttctcagcggtgaccacggtgacgggagcgttgatgacctcttccacggtctcgcccttgatggccttcagcgcggcctccacggcctggtagcccatctcatagggctgctgggcaacggtggccttcaccatctcgccggccaggatcagatccacggcggaggcgttgccgtcgaagccgacgataatcatgtcgtccacgccggcggacttgcaggcgttcatggcgccgatagcggtatcgtcattgtggcagagcacgatgtcgatctggtcgggataagcgttcagcaggtcctccatggtcttggtggcgccgtcggtggtgttctggccggacagagcgtccagaacggtgacgccggcctcgtcgcaggcggcctgatagccctcgcggcgcatattggaggtgttgtcgccctcctggccatagatgatgacggcgttggcgccctcaccggcctgttcagcggcccacaggccgccttccttcgcggcgtccacgttggaggtgcccacgaagctggtctgaccctcgatgcccacattggtatcgacggacagaacggggatgctgccgatggcgctggcaagcgcaccggaagcggcgccggcgtcattgggagcgacgatgatggcatcgcagcctgcgccgatctgctgctcaatcatagaaacctgctgctcgatctcgctctcagcgccggggcccaccacgttgacggtaacgcccaggtcagcggcagcggcatcgcagccggccttcacatagccccagtactcggaggccagggtcttcaggaccacagcgatctccacatcgctggcagtggcggtatcgccgccgttctcctcggtagcagtgtcatcggtgctggtgtcttcgttggcggtatctccgccgccgcaggccaccagagacagggacatcaccagtgcgaggagaagtgcaaaaaactttttcatcttacttcttttctccttcttaattggtttcctctcacattcaggcagaaatggatctgaactgcgggagtaagaagattttaacatggtgtgcttatacagtcaacgtgttaacgtaaaaaacagctattattacaattttgcggaacttttttgcacaatatgcagaaaattttttatcagctaatcatttacttgacagcgtcggctttttatcaggcgcccggcggcgtccagtttgcgcaaatttttcgcaaatctgccgcacagcctctctatcccccaaaaaccgctcccctgggtgtcgccgcaggcgcgcccgtcctacattatataatataaagaggtgcggacatgcctgttccgcacaaaaaacgccctcccggcttgggagggcgttcggaccatgtattctcagacggagatgattttccaggcgcaccagagcaggagcagcgccataacggcgttgacaaatttgtaataccggctgtacagcgggtacagcagcgcgcccagcgtggcccagatcaggtttccggtggcggcgcaggcagccatgatgacagagaagcacagcacggctggcaccgtatacccatggggcaggatataaccggaataggcggcgatccccagcatcaggatgtggacgttcaggaattgcaggaggaagccgttcacataggacagcggcttgccggaggggccggcctccttcttggcgccggggctgcgcatcagcgtgcggtaggccagatagaggatataagccgcgcccacatacttggccacggggacaatctgcggcaccagctctcccagccaggcacagccgaagccgcacagcagcataacggtgatcaatcccgcccagatcccaaaaatcagcggccagcacttccggatgccgtaccggctggtgctgctgaacagcagaatgttgttgggtcccggggaaaaggtggttgcacaggcatacgccgccagttgtaaatagactgctgtcatgggaactgcccctttctctttatcagatactgtcccgccgcggcgtcagctgaagacgccggccttgcacagctcgatgaactgcttggccacccgggcgctgcgtccgccggagcggaccgcgaatgcctcactgcggaccgccagctgtctggggtccagctccaccccgtactgcttggccagctcctccacaatgtggagataccgctcccggtcggggctgccgaaggtgatggtcagcccaaaccgggcggacaggctcatcagctcctggcgggtgtcgctctcgtggatgtcgtcgccctcccggtcggtgagggtctccttaatcaggtggcggcggttgctggtggcgtagacggcgatgttgccggcccggccgcccacgctgccctccaggatcgccttgagggcggcgaagttgtcgtcattggcggtgaagctcagatcatcgatgaagaggatgaacttcagcggattggacgccagggcgtccatcaggtccgggatctgatagagctggttcttcttgacctccaccagccgcagcccctggtccgcgaaggcgttggcgatggccttgatggcgctggacttgccggtgcccgcgtcaccatacagcagcacgttgttggcgggctttccctccagcagggcccgggtgttggcgatgaccttctcccgctcccgctcatagccaggcagctcctccagcctctggggatccgggtgcttcaccggcgccagttgcccctcctccaccgtgaacacgtggtaccgggcgaagatgccgtagcccttcacccccacctcctccatccggcggaggtattcccgggtgatatcggtgggagacacgacccagcccaccagaaattccggaggctcccgcagacccgccgtcaggtcctccagctgcagctgggagagctggtcgaagaaggccagctcccgccgcaggctttcctgaaggacggagctcctgcccaccgcctgcccccggatgcagacgttctcgctctccagcaccgtctcccgcagatagcaggaccagctgtcgctggactggaagagggcggcttcaaatccggcgcaggcggcggagaaatcgccgctgtccccccgcacccgggcggagagcatctcgccgcaggcggccaccaccgggtcctgcagcagccggcggaacaccacaaggcccgtcagccgccggtacatctcttgtacgtgcatgttgcattcctcccgatctcaggccttcagcggaggaccgcgccctcgtcggcgctggtgaccatccgggcgtaacggcccagccagccggtggtgatgttgggggcaggctggacataggcggccttccgggcggccagctcttcctcagatacctgcaacatgatggaggcattgggaatgtcgatggcgatggcgtcgccctcctgcaccaggccgatgggaccgccggaagcggcctccgggctgacgtggccgatggacgcgccccggctggcgccggagaaccggccgtcggtgataagggccacggttttgtccagacccatacccgcgagagcggaggtgggattcagcatctcccgcataccagggccgcccttggggccctcgtaccggatcaccaccacgtcgccggggacgatcttaccggcgtagatggcggcgatggcgtcctcctcgctgtcaaacacccgggcgggaccggtgtgggtcagcatctccggggccacggcgctgcgcttcaccacgcagccgtggggggccagattgccccagaggatctgcagtccgccggtgggggagtagggatcctcgatgggccgaatggcgttgtggttgaggttctggaccccctgaatgttctcgcccacggtcttgccggtgacggtcaggcagtccagatccagaagaccgcgcttggccagctccgcctggacagcagggatgccgccggccgcgtacaggtccggcatgtgggtggggcccgcaggggccaggtggcacaggttgggggtcttctcgctgatctcgttgaacagggccaggtccaccgggcagcccgcctcctgggcgatggccagcaggtgcagcaccgtgttggtggagcagcccagggccatgtcgcaggtcagggcgttgcggatgctgcgggcgttgatgatgtcccgtgcgcagatgttccggcggaccatctccatgatggcggcgccggcccggcggcccagctgcagccgcttgctgtacaccgcggggatggtgccgttgcccggcaggccgatgccgatggcctcgcacaggcagttcatggagttggcggtgtacatgccggagcagctgccgcagccgggacagcagttctgggtgcagtcctccagctgctcggcggagatcatgcctgccttgtaggagcccacagcctcgaacatcttggagaggctgacctcctggccgtcgtaggtgccggccagcatggggccgccgctgcacaccacggcgggcacgttcatccgcaccgccgccatcaccatgccggggacgatcttgtcacagttgggcaccagcacacagccgtcaaactggtgagccatgaacatggtctccacactgtcgcagatcagctcccggctggccagggagtacttcatgcccacatggcccatggcgatgccgtcgcacacgccgatggcgggcaccatgaagggggtaccgccggcggcctcgatgccgctttttaccgcgtcggtcagcttgtccaaattcatgtgtccgggaacgatgtcgctgtgggcgctgaccacagcgatcaggggcttctccaggtcctccggcgtgtagcccagggcgtagaaaaggctccggttgggtgcccgctcggcgcccttggtcacattatcactgcgcataggtcttgctttcctcctttttctacccggcccggaggtgttcccgcctccgggccggtgccttgggtcctcttactttttcagccagctcatcatgctgcgcagctgggcgcccaccttctcgatggggtgctcggccgccatgcggcgcatggccaggaagtgggtcttgcggcctccgttggggttcatctccgccaggaattcggaggcgaaggtaccgtcctggatctccttgaggatctgccgcatctccttgcgggtgtcctcggtaatcaggcggctgcgggtgcggtagtcgccgtactcagcggtgttggagatggagtagctcatcttgccgaagccgccctcgttgatgaggtcgatgatgagcttcatctcgtggcaggtctcgaagtaggccatctccggctcgtagccggcctccaccagggtctcgaagccggcctggatcaagccgcagacgccgccgcatagaacggcctgctcgccgaacaggtcggtctcggtctcctccttgaaggtggtctccaggatgccggcgcggccggcgccgatgccggaggcataggcgagagccacttctttggccttgccggtgaagttctgctccacgcagatcaggctgggcacgcccttgccctccaggtactggctgcggaccgtgtggccggggcccttgggagccaccatgatcacgtccacgttggcggggggcacgatggtcttgaagtggatattgaatccgtgggcgaaggccagggtcttgccctcggtcatgtacggggcgatctgcttgttgtagatgtcggcgcacagctcgtcaggcaccagcatcatcacgatgtcgccggccttggcggcctcctccacttccatcacgcggaaattgggacaggtggcggcgaactcctccgccttggcccagtgggaggagcccttccgcaggcccaccaccacgttgacaccgctctcggccaggttctcagaatgggcatggccctgagagccgaagccgatcacggccacggtcttgccgtccagcaggcccaggttgcagtcagtgtcgtaatactttttgattgccatgttcgtgttctccttttctgtttcttgacgatgtgggtgggaatggttttgccgatgggccctgaacagaacggccgaagtgaaagaaaaaagcctttgcctcttgcaagcaagaggcaaaggcttttgaaacaccttcgcggtaccactcttgttaacggtggaagatccttccgccgccatctcagcaggccccaacaggccctgcacggtaacgggtgcgcccggcactgcctatcagagagttctctttcagcaggctactccaggatgatttcaccagatccgacgcttgttgccttgcaccaaccggcaattctctgaaagcggagcgaagcgggctacttgttcccttcatcatattttaggtatgcaaagacggtaacacactgttccgccccctgtcaagagaaacttgcgctcaacttccccgctcccgcaaagttttattggtttgaccaattccatcccttttcaaacgcgaaaccttatgtattttccccacgattttccgccaagcctgtacagggaccggccagaccagcccaaatctttgcgcttagggttcctctttttgttaaatggaaatattttctaaatatttttgatttcaaaggagaagtgccagaaagtctcataacaggcgtttaaaacttgagaaatccgccgaacatgttcttgcgcggacaaaagtcgttgacgcaaagacgcgcccagtattacaatgtggtcgatacaaacacggacggaggccgcggcgcggtcatccgccaagtctggtttttggagggattcaccatgagcattcagaacgagtatctaagcggcctgatggagcgcgtggtccggcggaatccggcagagccggaatttcaccaggcggtccaggaggttctgacctccctggtcccggtggtggaggcgaagccggagtatatcaaagagggcgtcatggactgcctggtagagccggagcggatcatcaagttccgggtgccctgggaggatgaccagggcaacatccacgtgaaccggggcttccgggtgcagttcaacagcgccatcggcccctacaaaggcggcttacggttccacccctccgtgtacgagggcatcatcaagtttctgggctttgagcagatcttcaagaacagcctgaccggcctgcccatcggcggcggcaagggcggcagcgacttcgaccccaagggcaagtccgacgcggaggtcatgcgcttctgccagagcttcatgaccgagctcttcaagtatatcgggccggacaccgacgtgcccgccggcgatatcggcgtgggtgcccgggagatcggttatctcttcggccagtacaagcggctgcgcaacgagttcaccggcgtcctcactggcaagggcctcagctacggcggctctctggcccgaaccgaggccaccggctatggtctgtgctactttgccgacaatatgctcaaggacgcgggccgcagctttgagggcgccaaggtagccatctccggctccggcaatgtggccatctacgcctgcgaaaaggccacggccctgggcgccaaggtggtcaccatgtccgactccaacggctttgtccacgaccccaacggcatcgacctggcgctggtgaagcagctgaaggaggtggagcgcaagcgcatccgggagtatgtgaccgtccgcccggaagcggagtaccacgagggctgctccggcgtgtggcaggtgccctgtgacatcgccctgccttgcgccacccagaacgagctggatctgtccgctgccaaagccctgatccagaacggctgcttcgccgtggccgagggtgccaacatgccctgcactcccgacgcggtggaagccctgcaggctgccggtctcctctttgcccccgccaaggccgccaacgccggcggcgtggccacctccgccctggagatgagccagaattccatgcgcatgtcctggtccttcgaggaggtggacagccatctgaaggacattatgaccaacctttatcacaacgccgcgggcgccgccgcccagtacggcaagcccggcgacctggtggccggcgccaacatcgccggcttcctgaaagtggctgacgccatgctggcctacggtttggtctaaggagggcatctgcatgagcgactatgtttcccgcgtgtccgccgacctccagcagcggtacgccggccagccggagtatctccaggccgttctcacctggctggagatgattgccccggccctggaggacaatcccatctatgagcgggtggacctgctgacccgaatggtggagccggatcgaatgctgaccttcactgtgccctggatggacgatcagggcatggcccacaccaaccacggctaccgggtgcagttcaacagcgccatcggcccctacaagggtgggttgcggttccatccctccgtcaacccctctatcgtgaagttcctgggctttgagcagacctacaaaaacgccctgacggggctgcctatcggcggcgccgccggcggcgcggattttgatccccggggcaagagcagccgggagatcatgcgcttctgccagagcttcatgacagccctgtaccgtctgatcggcgcagacaccgacatccccgccggtgacatcggtgtgggctcccgggagatcggctatctctatggccagtacaagcggctcaccggaaaggcggagagcagcgctcttactggcaagggcctgacctacggcggcagcgtcatccgccaggaggccgccggcttcggcactgtttacttcttggcccggatgctggaacaccagggcgagaccctggagggcaagcgcctggccgtctccggcttcggcaacatgtcctggggcgtgtgccgcaagagcgcggagctgggcggcaaggtggtcaccctctccgggccggacggctatgtctacgatcccgacggcgtctgcacccaggagaagttcgatttcatgctgtccatgcgcgccggcggcgccgacaaggtggagccttacgccgaccgcttcggcgtggagttcttccccggcaaaaggccctgggaagtgccggtggacatcgtgatcccctgcgccacccagaatgagctggacgtggaggatgccgtgatgattgtggccaacaacgtccgctactatgtggaggcggccaatatgcccgccaccgccgaggccctgcgcctcctgcggctgagtcccaagatcctcaccgcaggctccaaggcctccggatccggcggcgtggtggtttccgccctggagatggtccagaacagcctgcggtacagctggacccgccaggaggtggacagccgcctgaagcagatcatgggcggcatctatgatgcctccgccgcggcggcggaggagtacggtctgggatacgacctgattgccggtaatgacatcgccgctttcaagaagatctccacggccatgatcgcccagggactgtgattctccccctcttcaaaacacacaaagcggccgcccttccgggcggccgctttgtcccataaatttcctttgtagtgggaccggcggtccggcagatgccgggccgccggttttgtttcccgtcccacagcgtccagaacagcccgctgatccggccgttctcgtccccattgatccgctccgcggccggtactttcggcagtcccggtatggcccctcacgggacaggtcccgcggggactccgcatttaatccagttgggcaggcccagcccgtccagctcaaggttttgcctccggcaaaacgcttggacgccgctcccgcggcggtatgaccatgcctcagaacagcccgctgatccggccgttctcatccacatcgatccgctccgcggccggtactttcggcaatcccggcatggtcatgatatctcccgtcagggccaccagaaagcctgccccagcggacactttcaggttccggaccgtcacagtgaagccccggggcgctcccagcagggaggggtcgtcggaaaagctgtactgggtcttggccatgcagatgggcagttccccgaaccccagctctgtcagccgccgggcctgcttctgggcggcaggcgtcagtaccacgccgtccgcatggtaaatccgccggcagatagtctccagcttctcttcgatggacccccccagcgcatagctgtaccggaagtcggatggctgctcacacagccggactacctcctctgccaaagcagttccgccggcgccgcccttggcccacacctcgctgagggccacgctcacccccagctcccggcatttctcctctaccagcttcagctccgccgccgtgtccgtggggaacgcattgatggccaccacgcagggcaggccaaatacgtttttgatattgtccacatgctggagcaggttgggcagtccccgctccagggccgctagatcctctctgcccagctccgctctggctgcgccgccgtggtgcttcaatgcccggaccgtggccacgaccaccaccgcgtcgggcttcagccccgccatgcggcacttgatgtccagaaacttctccgcccccagatccgcgccgaagcccgcttccgtgatggcatagtcccccagcttcagagccatccgggtggcggtgacggagttgcagccgtgggcgatgttggcaaagggtccgccgtggatcagggccggagtatgctccagcgtctgaaccagattgggcttcagagcgtccttcagcagggccgccatggcgccggccgccttcaggtcggcagcagtcaccggggcgtcatcataggtgtagcccaccacgatccgccccagacgggctttcagatccgggatgtccgatgccagacacagcacggccatgacctcgctggccacggtgatatcaaatccgtcctcccggggcacaccctgcatccggccccccaggccatccacgatgctgcgcagctgccggtcgttcatatccacacaccgccgccacgtaatccgcttgacgtcgatccccagggcgttaccctgctggatgtggttgtccaacatcgccgccagcaggttgttggccgcgccgatggcgtgaaagtccccggtgaagtggagattgatgtcctccataggcaccacctgggcatagccgccgccggcggcgccgcccttgatgccgaacaccggccccagggagggctcccgcagggccaccacggcatttctgccgatccgccgcagcccgtccgccagccctaccgtagtggtggtcttgccttccccggcaggggtgggggtgatagcggtcaccagaaccagcttaccgtccggccgatttgtctccttcagaaagcggttgtcgatcttggctttgtatctgccgtattgctctatatacgccccatccatcccgcaggcgtccgcaatatccgtgatgggaaggggcttcgcctcctgggcgatctcgatatcgcttttgatggtcatggctgcctcctgttttccgggctgtccgtgtccagacaccctgctgtttcatgttcgattataccggctcccccgggtaaaagcaacagttctctccaaatccccttattttccaaccttttacaggtaaaacaccggcggcacctgctacatagcggtctctgcgtccatgtcctttgttatctgtaaatgtgatagccggttgcataagatccgttctagcagtttctcctccgcagatgctataatattgtacagagaagaaggcgcttatatcttaaaaactgtgcattcagacgaacagaggtgtatgaaaagaggaaagagcacataaggaggtacgtatatggaaactctggagaaaaaaggcaaaggttccgcgttgctcccgttcctgctatttattgtcatctatctaggcgctggcctgtacttccaggcacagggtgtagagatggccttctaccagttcccctctgtcacagccatgttcattgccctgctgctggccttctgccagggcaagggcaccatcgatcagaaattcacagtcttcgccaagggcgccgccaacgagaacgtcctgaccatgctgatgatctacatcctggccggcgccttctccaccgtggccagtgccatgggcggcgtggacgccaccgtgaatctgggtctcagcgtcattcccgtgcacttcctggccgccggcgtgttcgtgatctccgcgttcatgggcaccgccaccggcacctccatgggcaccatcagcgccattgttcctatcgctgtgggcgtggcggaaaagggcgggttgagccttcccctgtttctgggcgcctgcgtgggcggcgccatgttcggcgacaacctctctatgatctccgacaccaccattgccgccacccgcacccagggctgccagctccgggacaagttccgggtgaacttcctcattgccctgccggcggctatcatcaccatcatcgtgctgctggtcgtaggccggcctgagaccgtgacggagatgggaaatctgtctttcaacgtcatcaaggtcattccctacctcgccgtgctggtactggcgctgatcggcatgaatgtgttcctggtgctgaccatcggcatcttcgccgccggcatcatcggcctggcccttggcgatctggatatcccactctttgcccaaagcatctggaacggtttcaccggcatgaacgaggtcttcttcctgtccctgttctgcggcggcatgtctgagatgatcgcccacaacggcggcatcacttggctgatcgaaaagctgggccgcatgatgaagggcaacaagtccgcccaggtgggtgtcgcggctctggtgtccctggcagactgtgccactgccaacaatacggtggccatcattgtcagcggccccatggccaaaaacatgagccgtatccacaaagtggatccccgccgcaccgcctctctgctggacgtgttctcctgtgtgcttcagggcatgatcccctggggcgcccagctgctgactgccgccagcctcaccacgatatacggcgtgaccatgaaccccatagacatcctgccctatatgtggtactgctggattctggccgccgtgggcatcctctccattttcattcccttcgccgacggcatctgccgcaaggacccctggaactgggagtacgatgtggcggagtccggcgtggctgccaagaaggcttctctggagctggagcggcaggagtccgcgcagacgcccatctgacctgcgtgtctcttgctaaaaaaagaccgggcgccctgaggcgcccggtctttttctcctctgtcaggtcccctcctgaagccgcctggtgaaggcgatggaatccgccagcgcctcctccagcaggcggacgaactgctccgtcagcggagagggccggctgctgcggatgtggatccagcccaggtggaccgaggtcttccccagcagcgggatcgtgactacgcttccgtccgccagcccctccgacagcaggccgctgccggaggtgaacgcatcggtggacgccagcacgtacatcgccgtggcccggttgttcacgctgatgcactttgccggctttttcagagagaccatggggtactcctcgaaaaagtccgacgccacgccttggtcgtgctcaaacgccacatacggatatccgtccagttcctcctccgttacgctggagcggccagccagcggatgccccccgcgaacatagatacaggggcagacggcggccagttcgtggaattccagctcccgggcgtccagcagccggcagataatcttctccgtcagatccgtcaggcagatgacgcccacgtccgcccggtggtcatagacgtcgtcaatcacaccgtccatccctgtctcccggaggccaaatcggaagcggttttcaccggcgattcggagcagcctcaaaaacgcgtccactgcaaagggataccgctggcaggaaacggaaaagcgcaccggagccgcggcgttgcgtgcctcaccatacaggctctcgatcccgcgcttctgctccagcagggagacggcgtagctgagaaactccttgccctccggcgtgaactccacgccccggttgctgcgggccagcacccgaatgcccagttcgttctcaagctcccgcaccgccgtggaaatccccgactgggacaggaacagcttctgggccgccttgttgatggagccgcatttggagatctccacgatgtactcaagctgctgaaacgtcatagaaagcctcctcttcccctttcgatctcacttttctattataggcattttgagctggttgtcaaatcgttatcaaaaaaactgtcaacgcatcccgcaaaacgcatattaacagctttgcgccctttgtgctattctataagtagaaccaaacaaaagatatcagttatttgagaaattttctgtttaatatcacctgcgtttttcgatggatgcacagattttccccctctcttctctctatccccgcagccgcgtcagagtctctctgatagcgaaaatttgaataccagtcaattttgcccctgcggagcgtctccggaggggccggtgaagaaaggaagatcgactgtatgaacacggagaaaaagttcggttttgccacgcgtcagatccacgccggccacatggaaaacgcggcgggctccttgtgcgcccccatctatcagacctccaccttcgcattctccaccgtccagcagggcggcgcccggttcgccggcgaggagggcggatatatctacacccgtctgggcaaccccactctgggcgctgttgaggagaagctggcctccctggagggcggcgaggccgccatggccgcggcctccggcatgggcgccatctcctccgccctgtggacctctgtggtggccggggacgagatcgtggcggatgagacgctgtacggctgtacatacgcgctgctgaaccatggcatgaccaagttcggcgtgaaggtcaccctgacggacctgtccgacattgagaacctgaagaagaacctcaccgacaagacccgggtggtgtacttcgagaccccctgcaaccccacgctgaagctgctggacatcgagctgatcgccaagacggcccatgccttcaaccccgacatccgggtgatcgtggacaacaccttctgcacaccgtacctgcagcgtcctctggagctgggcgcggacgtggtggttcacagcgccaccaagtacctcaacggccacggcgacgtgatcgcaggcatcgtggtgggcaaggcggacttcatctcccagtgccggatgttcggcctgaaggatatgaccggcgccgtcctgagtccctttgatgcgttcttgatggcccggggcctgaagaccctggacatccgcatggagcgccactgcgccaacgcccagaaggtggcggcgttcttcaccagccatcccgcggtggccaaggtctattatcccggcctggacaccttccccggtcacgagatcgcggccaagcagatgaagctgcccggcggcatgatctccatcgagctgaaggccgaccgcgccgctgttgccgccgcgctgaacaagctgcagctgtgcaccatcgccgtgtctctgggcgatgcggaaactctggtggagcatcccgccaccatgacccactccacctattctgccgaagagctggcagccgccggcatctccgagggcttggtccgcatcagtgtgggtctggaggatcccgaggatatcatcgacgatttcaagacggttttggatacgctgtaattgatcccgctgcggggccgctcctcctctcctacattgggagcagccccgctttcccgcggatccgcgtacctccttttcgccgtcccggtctttccccaccctgccggaggcggccaaaaaggcccggcttctccgccgggcctttttgtgcttctgtacctgccgcctgttgtgcgtctctcctcccgcggcgggcggcccttgagcaggaaaaagcgccgtgcgcacatgcgcacggcgctttttcctgtttggttcagagaggtaagcgtggggaatgctcagtcctcagccattttgcgatacttggcgtagcggtccttggcgtcctggacggtcttctcgtacaggcgctgggcccggtccgggaagttgatctgcagggaggcatagcggttctcgcccttcagatagtccatcatcttgccgctgtcgggctcgggagaatccagctggaaggggttcttcccctccgcgatccggcggggatcataccggtacagatgccagtagccgcactccaccgccttcttcatctcctcctgcgtgcagctcatgcccgccttgataccgtgctccaggcaggggcagtaagcgatgacgatggccgggccgggataggactctgcctcccggatggccttcagggtctgggcttggtcgtagcccatggccacctgggccacgtagatgtagccgtagctcatggcgatggcgcccaggtcctttttcttgacctccttgccgccggcggcgaacttggccactgccgcagtgggcgtcgccttggaggactgtccgccagtgttggagtacacctccgtatccatcaccagcatgttgatgtcccggttctgggccagcacgtggtcaatgccgccgaagccgatgtcgtaagcccagccgtcgccgccgaaggcccacacgctcttcttggtcagatactccttgttctgcaggacaaaggcgccctcctccgtgggctccgccttctccagggcggcgatcagcgcgtcggacacctcccgggtcacggccgggtcctgccacttggcaagatactccccgatctcagatacggccacacccttttccttcagggctttcagccgcagctccacctccccatggatggacccgtgggcccgcaggaagccgtaggcgaactccgcgttgtcctcgaacagggactgctcccagcagggtccaaagccccggctgtcgcaggagtagggcgtcatgggcatggcaccgccgtaggcggaggagcagccggaggcgttggccacgtacatgcggctgccgaacagctgggtcaccagcttgatgtaggtggtctccgcgcagcccgcgcaggcggcggagaactggaagtagggcttggcgaactgggccgtcttcacgctcttgtcgctgataatgtccttcttcagcagcttctcgttcatcgcgtagttgtcgaagttgggctgctgctccctctgggtctcgaagggcaccatctccagcgcccccttggccgggcaggcggtcaggcacacgccgcagcccaggcagtcgtagggagagacctgcatccggaaggaataggcaggggcgtccttgcccaggcccttggcgggcacggtgacgaaggattccggcgcaccggccttctcctcctccgtcagcagcacgggccggatggccgcgtggggacacgccatggcacagcggttgcactggatgcacacgtcgggattccactggggcaccgtgacagccacgccccgcttggagtatgcggtggtgccattctcccaggtgccgtccaggcagttgtgcctcttgaacagggacaccggcagcttgtcgccgtgctggcggtccatgggcaccacgatctccttgacgaagtccgtgcccttcagctcctccggcgcgccgtccttggcgtccgcccaggcggcggggacctccaccttcgtcatgccggtcagacccacgtccacagcccggttgttcaggtccacgatctcctggccgccctttttgaagtaggagttgtagttgccctgcttcatctcctccaccgccaggtcgatggggatcaccttggtcagctggaagaaggccgcctggagaatcgtgttgatccggttgcccaggcccaggtcccgagccagcttcgtggcgtccatgatgtagaagttggcgtgcttgttggccaggtcccgcttcatcttggcgggcagccgctcctccagctcctccgcgctccagggacagttcagcaggtatgtgccgccgtccttgaggtccgcggtggtgtcatatttgtccacataggtgggcgcgtggacgcccacgaagtccgccgcggataccagatacgtggcgtgaatgggctggtcgccgaaccgcaggtggctctgggtcagaccgccggacttcatggaatcgtaggagaaatacgcctgggcgtacttgtctgccgccaggccgatggtggtgatggcgttcttgttggcgcccaccgtgccgtcgccgcccaggccccagatcttgcaggatacctgtccgggatagtccagggcgatctcctcataaggcaaggaggtgaaggtcacgtcgtcctcgatgccgatggtgaagctgttcttgggctcctccttggccaggttgtcgtacaccgccacgatctggccgggcgtggtgtccttggaggccaggccgtaccgaccgcccaccaccacgatgtccttccgccccgcctgctgcagggcgctctgcacatccagatacagcggctcacccacggagccggactccttcgtccggtccagcacggcgatcttcttgcaggtggcggggatcgcatccacaaaatgccggatggagaaggggcggtacaggtgcacctgcaccatgcccaccttgcggcccttcctgttcagatagtccaccgtgtccttcaccgtctccgcaccggagcacatgatgacgatgacttcctccgcatcgggcgcgccgtagtagttgaacagcttgtaatcccggccggtgagcttgttgatctcatccatgtagtgctggaccacgccggggatcgtggcgatcttctcgttggcgccctccttgcactggaagaacacgtccggattcaccgtcgtgccccgggtggaggggtgctccgggttcaggccgttcttgcggaacgccgccagctggtcatagtccaccagcttggccaggtcgtcatagtccagcgcctcgatccgctgcatctcgtgggaggtgcggaagccgtcgaagcagtgcatgaaggcataccggccgccgatggcggacaggtgggccaccgcgcccaggtccatggcctcctggggggaggaggacatcagcatgccgaagccggtcattcggcaggtcatcacgtcggagtggtcgccgaagatggacagggcgtgggcactgacagtccggcaggagatgtggaacacgccgggcaggaactcgccgccgatcttgtacataggcgggatcatcagcagcaggccctgagaggccgtgtaggtggtggtcagcgcgcccgcctgcagggatccgtggcaggtgcctgcggcccccgcctcggactgcatctcaatgacctccacgggttttccgaagatgttggtcctccccttggcggaccactcgtccaccttctccgccatcacggaagatggcgtgatggggaagatggccgccacctctgtgaacgcgtaggacgcgtacgccgcggcggtgttaccatccattactactagttttttcttagccatgtctcctgttttcctttcgatctcacttggtctgttctcattgcctcaacaccgtccgctgcccgctccggggcagcggacggcactccagggagcttactttataccgggataggcccgggccacatagtcggcaatcctgcgcaccgcctccttcaggttttcgtcggagttggcgaataccagccgcagatagccctcgcccatgtcgccgaaggcggagccgggcaccgtcaccactcctgcgttctccagcagctcctccgcaaacgcttgggaggtcttgccgaatgccttgatgttggggaaggcgtagaagctgcccgcggacttcttgcaggtgatgccggggatagcgttgagtccgtccaccagaatgtcccggcggcgggtgtagtccgccaccatctggtccacgcacgccgtgctcttcagggcctccaccgccgccgcctgggtgaaggtggacacacaggaggccaccccctcctgcagctgcgccattttcttgatgtaccccggctccggcgctaccagatagccgatccgccagccggtcatggcataggacttggagaagctgttcagcaccatcacgcggtcctgcatctcgggcacctgggccatgctgtacggctggatgccgtcgtatacgatggcgtcatagggctcgtctgtcagcacccacaggtcatgggtcttcgccaccttggcgatggccaggatgtcctccttcgtcagcaccgcgccggtgggattgcagggggagttcagcaggatcgcccgggtccggggtgtgacggccttttcgatatccgccgcttggatccggtagtcatattcctcatacgtggggacgggcaccgctctggcgccgatgctgctggcctgcccgtagtagttggggaagcagggatccggcaccaggatttcatcgcccgggtccagcagcgtcatcatggccaggaacaagccctccatggcccccacggtgatgatgacgtggtctttggtatagccctcccagtactgcttccggtacttggcggccacagcctcccgcagctctgtggtgccggcgttgggcgcgtaatgggtctgcccctcgtccagggctctcttcgccgcgtccttgatgtactggggcgtgtcgaagttgggttcgcccaccgtcagcttgatcgcctccgggtattgggccgccagatcaaacatctttcggatgccggacgctggatactgcttcgcccgctgggaaatgcgcagttcctgttccattggtaacatctccttttgatcatcttctcacgcgcacccggcgcacccgttccgaaagcgggcacgccgaatgcgcagcaggcagttccttacttcgcagccttgtcgttcacccacagctccgggatggcgttggccgccgcctcactggtgggctcccacttgccggacttcagccgggtcaggtaatcgttgatcagtgcgccgatctgcttgcgcatcaggaagcagaccaccaggttacacacggcgcacacaccgaagaagaagtcgaagagattccacagcacactgagggcgcccacagagccgatgatggcgaaggcgcagcccaggagccggtagggcagaatgaacttcttgccgcccaggacggtcatgcagatctcaccgtagtacacattgaccagcgcggtggtgaaggcaaagaaggtgatgatggccaccacgaacaccgtgccagcgatggcgttgccgaaaccggcgccgaaagcagtggcggtcagggccgcgccggtgccgccctcggtccacacgccggtgcacaggaccaccagagcggtcatggtgcagacgatgatggtgtccacgaacacctcgctgatgccccacaggccctgcttcaccggatggttggcggaagaggaggagtgggccagcggcgccatgccggtgccggcctcattggagtacacgccgcgggccaggccccaacggatggccagcatcacggtggagccggcaaagccgccggtggcagccataggcgtaaaggcgtactcaaaaatcatcgcaaagacgtgcgggatgttgctgccgaactttaccagaataaagatgctgccgatcacataggccagcgccatcagggggaccaccttctccgcaaaggaggagatactcttgatgccgcccaccagcacaacggccatgatgacggcaaagatcacgcccacgatccagccgggaacgtcaaaggagacccgaatcgcctccaccacagagttggcctgcacggcgggcgcaaacaccatggcgcagcccaggatcacagcccagaaaatgcccagccacttccagctcttgcccagcccccggcgcacataccaatagaagccaccgtgccatctgccggtctcaggatcccgctcccggtaggccatgcccagggtgatctcggaaaacttcacgatgaagcccatgagggccacggcccacatccagaatacggcgccagggccgccggtggcgatggccaccgatacaccggcgatgttccccacgccaagcgtggaggccagcgccgtgcagcaggcctggaacggggaaatatcgccctcgccgtcgcccttgtcgaagatcttgccgaacgtgttcttcatggcgtgtccgaacctggtgaattggaagaacttaaagcggacggacagatacacggcgactgcggatgtcaggatcagaagcggccatccccacagccagttggaaatcgccatcatgatgtcgatgataaacatattctacctcccaaataacttcatgcgctccattttcgattggctgaatcatctgtcgggaagtctttccccgcggcttccccggctcctcctttcctcctatattcgatatgcggccagccgcataacttgcctgatttccaataattccgtatggtggaagcgaattcctttgggtagaattgtcaaagctgccggtcttttctggacatgtatccaaaaaagcggcagcttttccgtagaacgggatcattttccaaaattgtgtcaaaaaccaaagccgcaactgcggcccgacacgaagcatttccacggaaaattacggatcctgttttctttccttatgatttatgatattatatagacaaacatttgtcaaggcagaatgtttctatgatatcgccaaaaaggagcggccgatttatggcaaaagaacaggtatccagcatcctccgcgccctggagattttggagtgcttcatggataacgagacggaatggacgttgaagcgcctggtggcacagctggatctgcccaccaccactgtccaccgccagctctccaccctcacggaccggggttatctggtccaggatcccgtccgcaagagctaccgggtggggccacgcctcctgctgctctccagcaccgtcctcagccactccgatctgcgcagtaccgcccggccggagctggaaaagctgtccgccactgtgaaggagaccatcaacctcagcgtgatgctggaccgggagatcttttatctggacaaagtggagaccttccgctccgtggtgtgcaacacgaaagtgggcacccgagccccggcccacgccaccagcggcggcaagatcatgctggcctttcacgatcccgattatgtggacgcctactgccgggacctgccccagatgcagcggctgacggaccgcaccgtcttctccccggacctgctgcgggagcagctggcccaggcccggatcaacggcttcgccattgacgacggggagatcgaacccggcctgatctgcgtgggcgcccccatcttcggtctggaccagacggtggtggcggcggtcagcatcgccggtcccaccttccgtatgaaagaagagctggacgtgatgactcgtgccgtgaaggccactgccgccaacatctcccgcctgatgggcgggcggccgtgacgcggcctgttttccagctgtcaggagcgggagcccataaggactcccgctcctgctgcttttacttccgcttccggaacagctccggcagtctccagccacggccctttccccgctccgtggcccgcatctggggaggatggtccagatagaactgctggacggaaaccggcaccgcgccggcctgctccgcccggacaaagcccccgtccggcagcatccgccgggccttcacattgtctcccagaagccgggccagatagtccgagaggaagtcctgcacctcccggctctccaccgggcaggcgatctccacccgccgctcctgatttcgggtcatgatgtccgcagaggataagtacatctgccgcagggcaccctccccgaagcagtagatgcgggagtgctccagaaactcccccacgatgctggtcacggtgatatggtccgtcttgcccggcacgccgggcaccaggcagcagatgccccggacgatcaggtccacccgcactcctgcctgggaggcctccgccagcttgtcgatcagctcccgctccgtgacggcgttggtcttcaggataatccgcccccggtcgccccgggcgatctccccgtcgatgagccgtaacagcgtctgcttcagggacaccggcgccaccagcagcttaccgtagctgccccgcaaatcgccgatcagcatattctggaaaaaggccacgccatcggcggcaatggtccgatccgccgtcaacagggagaagtctgtgtacagcgccgcggtcttttcgttgtaattgcccgtgccgatctgagtcacatagctgagccccgtcttctcctttcgggtgatgaggcagatcttgccgtggcacttatagccggcgggtccgtaaatcacccggcacccggcctcctccagctcccgggcccaggtgatgttgttgccctcgtcaaagcgggcccgcagctccaccagcaccgtcacggccttgccgttctccgccgcggcgcacaggtgcttgatgacggcggacttccccgccacccggtaaatggtcatctggatggacaccaccgccgggtccgcggcgctctggcgcagcaggtccagaaacggctgcatggagtggtagggatagaacagcagcacgtcccgctggcggatctgctcccacatgggcacctcccggtccagccaggcgggatatgccggcgcgtggggcgggtaaaagagggcgctgtccagactgtccagctggtaggcgtatttcagaaccagcgggcaggtgcacacatagctctgctccgccgtcagcctcagccgccggagcagcatggcctgcagagccggggcctccccctgcatctccagccgcaccggggccagccgctcccgctggcgcagcagcttggtcatctgggcgcgcaggtccaggtcctcctggtccatagcctcatcatagctgatgtctgcgttccgggtgacggacaccaccgcctgctcctcgatctgatagatcttgaagatcttccgcaggtggtgggccagaatgtcctccgtccgcacgaaggcgccgggccgggccggcagaggcaggatgggcggcaccacatccggcacccccacgatgcccagccgccgcttgtctccctcccgcagcagggcggcggcatacagggtcttgttcttcaggtggggaaaggggtggctggggtcgatgatctggggcatcagcaacgggcgcatggcctcccggtaccaggcccgcacatactcccgctcaccatttttcagctccttgtaggggatatccgccaccccatgttccgccagggcctccatcagctcccggtatacctggtcccgctgccggaccagcggcaccacggcggcatagatccgccgcagctgttccgccggggagaacccgcccttgttttcccgggcgttcggggccactagggctaggtccgtcaggcttcccacccgcaccatgaagaactcgtccaggttgctggtgaagatggagagaaagcgcagacgctccatcagcggcacagaggggtccgccgcctcctccagcacccgctggtcaaaggccagccaactgagttcccggttctgggtgtaactcaggtcccagcgttcagcagcttgtgacacagatatccctccctgacgccgtagggactgatatacagctctccttcgcacagcgcctctgtcagtgcatccatcagcacgatgcccggcagaatcgtgtgcacccggtccgggcagtgccgcaggatcagcttccgcgcctggtggtcccgcttcaacagcagctttgtcagccggcggacctccgcaggcgtcaggatgcggtttcccgccggcttttcataccagtcattggcgattttcagcgccgcccgggccgtgccgcccacgccgcagacccgttccgcccggtgcgccggcagccgggcctccttcagggccgcggccacggtgctgcggatccgctccagctcctttttcttgggccacaggccgtccacgcagcgattgaacagctccagggatccgatgggcaggctctgggcctttttgacctccccggcccggacctccaggacctctgcgctgccgccgccaatgtcgaacatggcgccgtcctgcaagtccgtggccgtccgggcgccgtagtagcccagtctggcctccagctcgccggagatcacatccacccccacgccggtggccgcccgaatctgctccactgcctcctccgtgttgcggatgttccgcagggaggcggtggcaaatacgtggggggcgtccagatcaaactgccgcagcagcgcctgaaagtcccggatggccccgcaggcccgctggattccctccggagagagcacccctccgtggacgtagctgaccagtcccgccatctccttttcggaaaacagcaggtcgaatccgccctccggcagggtgttgtagacggacagtcggatggtgttggaccccaggtccacaatggcgaatttcatgggtatgacgctccttcttcccgcgctccccactgggatgcggcgtttcacgtttatcagattgacagaggcagatgaaattcaaaagcgcggtgctgtaaaatgccggtaaaattcaggctttttcgatggctctggccacagcggccagggcctgggcctccgtgtcgtcaaaaaggtgggtgtagatgttgctggtgacggtcatggagctgtgccccagggtgcgggagatatcgaacatgggcacgccctggctgttggccaccgaggcaaagctgtgccgcaggccgtggagggagatcttgggcagcccctgccgccgcaccaccgtcagcaggtcccgggtcagctggtccggcttggggggcgccccgtcctgccgcagcaccacccactccttcgggtcgtcgctgcgccgcctctcccacgcccgccgcagcacctgctgcaggtcctggagcccggtgatgcccagccgccgggcggaggtgcgggtcttgggggacttcagcaccacgctgccgcccacctctgtgcgcacctcccggatggagagcagccccgcctccaggtccacattctcccaccgcaggccgcagatctcgctgcgccgcaggcccagataggccgccagcttcaccggcagctccatcatcgtgccggacacggcggagaacagcagctgcagctgctccggggagtaaaagctgaagcgggcctccttcttcttgggcggcgtcacccggtccatggggctgcgttccagcatctccagccgcaccgccatgcccagggccgtggtcagcatcacatagtgcttgatgaccgtgttgggggacaggccctggttcatcttctcatagagatagccctggatacgcaggggcgtcagctccgccagagggatccttcccagggcaggcagcacatgacagcgtgccatgttgcggtaggcgtacagcgtgctctccgcccggtcccgggccaccacctcctccagccagaaggtcagccactcccccagtgtgcagtccttccccggcaggcgccggtcggcacaggagttcccctccagcgcggcctgggcctcctccctggtgcggtaggtgcgggtatagcgccgtccgtcctgccggaacaccgcgtaatacagctgccgctccgtgtcgtatgcaagattcttctggatcgtctttctgggcatgggtgcattcctctctctttctctctcgttttgcgatgcagacgcatcgcaaaagggccgtgtgccgccgaccacggcgcggcctgaaatttcagcgcacggaccgggacagcccacatgcgcgaaaacttcatgcgccgccggggcagctgattttcgcggcgccccactgcccatgaagttttatgcccttttatcataaacaactcacgctgtccaataggatacccatattcggtcagacaaaacacaattattgtaaatttccgggcccgctccggccctctattcatgtagggccggggcgaatgccccttctgccgcaggctttttcacggcctgcgggacaaaaaagcggctgcctgcggcagccgctctccaagagccgattcacttcgcgtccttcactcccatccggcaggcggcccacaccgcgttgtggtccgagagctcctcccccgcaaagcgagccagggcggagtccggccgggcaaagccacagtccgccgtccgggtagaaagggtgcggctcttggtgggtgtcatcccccgcagcagcagccagtccagccgcaggcccaggcatccgccgcccggcaggggcttgcgccgggttaaaatgggcgtctccggcactgcccggtagcccatggcctccgccgccgtcagggcagcctcatactgcgccacgtcttccagacagcggcgctggagtgccggactccccgcgatctcccggatggcgtccttgtcccggccgtcaaaggtgttggtgttcagatctccccccagcactaccggaatgccgggaagcagttcctccgccgcacggagcaccgcctccagctggagccgccgtccctcgccatgggtgcggttctccaggtggatggaggccacgcccagaggccgaccgcccacatccagctccgccagcaccgcgcatcgcccgccaatccggcgctggcggtcgaagtaccagttgtactgctccggcagccgcacggtccacgcccgccggatgggccagcgggagaacaccgcatttccgtggaagcccttggggtcctccccattcaccagctcgatgaactccaggccgtaggcgtagttccagccgaaccgctccgccagctcccgcgcggtgttccggccgccagagcggacgcagccatcatccagctcattggccagcaccacatccaggggccggacgcccgggcagtcctgaagaaagtcgcccagctcctccaggtggacgccccgctccatattgaacaccagcaggcccagctcctccggcacctccgccggggccggcaccggtgcgccgatctccgtctccgaaaactgggggatcatggccatcaccgtctcctgcgtctcgtggtccagcagcgcacccaggcgctggcgctccgtattggggatacccttcatagtgtccttcctccttgtgttctgggggcgcaggtggagcggaccaccagctccggctggagcaggtccgctgtcggccgccggtccccctgaatctggcacagcagccgctccacggcgatgcgtccctgctgaaatttatgctgcgaaacagtggtcagatggatacggggaatggcggcgtaggagacgttgtcataccccaccagggacaggtcctccggcacccggatcccccgctcttccgccgcctccaaaattctgagggcggtcaggtctgaaaatgccagcacggcgtggggcagcgtccgctccccgaacagtgccaacgcctgttcataggcccactggcgcagttcccgggtgtccggcggcgcgggcagcacccggccggagagcccgtgctctctcagcgcccggcgaaagccccgcacccgctgcacacgggtgagagagtccgcacgcccacccaaaaacaccaggtcccggtggcccagctgcagcagataccggacggcgatggccgcccccgcctcattgtccgccatcacatagctgcacttctccccgtggttcacgcccaggtacacgcagggggtgccctccagcaggtcggcgtgcttggcctggctctcccgggacaggggcgagatcagcacgccgtcgatctgccgggccagaaagttctcgatggctcgaagctcccgtccctcctcctggagggagttgctcaacagcacccggtacccgttttccgctgccgtctcctcaatggcagtggcgatgcccgtgaagtaggggttggacacgtccggcaccactacccccagagtgtgggtggcctgccccgtgagccccttggcggcggcgttgggcacgtatcccagctgggcacaggcggcccggacccgttccttggtctctgcgctgatctccgggcggtcgtccagagtccgggacacagtggccgggctgaccccggccagcgctgccacgtccttaatggtcgtccgccgcatcccgttctccctcctatttgtgcaaacgtttccaatagcacctttaagataccattccggcagggaaactgtcaagtttcttcgtctgttttaccatgtttttgtgggtttttaatatattttctccagtatcttccggaacggcattctggtataatgcttctatgaaaaaagctgcacagcagaaggaggacttttatggcccgcatgaccatcagggacattgcccggctggccggggtctccgtcaccaccgtttcccgggcgctgaacaatgcgccggagatcaactcccagacccgggagcgcgtgctccaggtgtgccgggaacagggctaccgctccaacctgctggctcggagcctagtctccagccggacccgtgtgctgggcgtcattctgccggagctctccggcccttttcacgcctccatcgtgctgcacctggagcgctacgcccaggaacaggactaccagatcatgttgtgctgcggccgggtagggggcagcgaaaccgccgccctgttcgactttctggtaagtcaccgggtggacggcattctgctggtcagtgccagcagcgccgcgcccgatctgctgcggcgccacgcacgggggacgccctccgtgctgctgggggatgtgtccccgaccgctacgctccagcggatcaacgctgtcagcaccgacaactatgtaggcggcgccatggcggccggatacctctcccggctggggcaccggcgggtgctgtatctgggcccccggcgggacagcgtcacccatgtgctccggcaccagggctttctcaccatcgccagggagcggggcatggaggtggagaccgtcttcaaccccggcgccgtctcctccgcccccaacggctaccggctggccaggcaggtgttcgcccgccccttcccgcagacggcggtcttcgctccctctgacgccatggccctgggtgtcctccaggcggcagacgagctgggactggacattcccggccggatctccctgctgggctatgacgatatcgaatacgcctccctgccgaaaatccgcctcagcactctggcccagcccaccggggccctggcagagagcgctgtgcggctgctgctggagctgatcgactccggcgggccgggggaggtcacccacaagctgatcgccccccggctggtagagcgcaacacctgctgctctccgcagcagaggactgcggtctagcggcccgggcatccgaacaaaacaagcccccggcttttcagccgggggctcgcttatactgctcagggaagatagttcagcgggttgcgggccacgccgttgtaacggacctcgaagtggcagtgattgccggtggagttgccggtggagcccacccgtgcgatctgctggcccttgtagacgtggtcgcccacggagaccgtcaggctgctgttgtgaccgtaccgggtcacatagccgttaccgtggttgatctccaccaggtagccgtagccgcccatccagccggagtaggtgactgtgccgccgtccgccgcgtagaccggcgtgccgtacggcccggcaatatcgatgccctgatggttggtggagccaatgccgccgggagaggaccgtccgccgaagcgggaggtgatccggccactgatgggccaccggaacgtgccggtgggcagccaggtgggccgctccttcgtgccctggagccgctgctccgtcacgggctccttcagggtgacagaggagaggatcgtccgctccgtctccacaccgttgacataggtgacgttggccaccacgtcggcggcgccgtactcaccgggggaagtcacctgatagtcgcccttgtacagataggcagagtccgtatactccacatcatacatgacgtcttccacgtagtattcccgctgcttcactgtcactgtaagataggggacggcctccgacagcgtcagcacctcgccgatctggatcttgtcgatgttgtagccggggttcagcgccagcagttccttggaggtcattccgtgatcctccgcgatctcggaccaggtgtcacccgccttcacggtgtacgtggtctcagcggtcttcgtgctgtacagcagctccgccagataccccaggttcatcaccttttccgtgggcacgtactcctgcttgatctccacatcctccgcaaattcgcaggagatggtgttctcgtccgcggtgctgctctggagctggctcagcagctcctccagtgcgccctcatagggggtcgcgcccaccagctcaccgtccacatacagactgtacgcctgggtgaccagaccgatctgctgggacaggtcctcctccagcgtcgtctcgtctaccacgtcctgccgcagcagcaggccggaggaatactgcagcagggagtcgtcgatggtgtagctctcccccagcgtccgggcggtgaccgcctccaggtccgacgcggcctcctccgctgcggattgggagcccacagcggcaatcacctcgccgtcgtacaaaaccgtcgtcccgaaggtgtagacggagaagaacaacccgatggcagcagccacgcagccgccgcacagcagcatcgctggatgcaggcgccagcggtgccccagcttggcccgcagggcagagacccgctcacgccgctgcttccggctggcgcggatccgttcgcccagcagccccccagagtgggcagcattccccaggccagcagaagcaactgcacaggaagccgctcagactccgggaaccgctttgcctttttctcccgtaccagacgccgccagtggcggcgggtattcttggccttttccgccagcgcctggcagccggtcaccacagggctgatctccccctccgtgtcctgccaggactgcacagcctgccgcagcctccggcgccggggctctgtccgtcgggacggaccagcgggctcctctccccactcggggatcaagggcttcaccgccgtcggtgcggatacgggctccggctgcacctccgggggcgtgggcggacacttcctctcccgctccgcctgtccagcagccagacgcttgccgccgcggcgggactgccgggcggcatgatcgcttttctgaatatgttcgctcatatcgtctccgtaaaatccagcgaaatagttacaatttgttaccgtttgtaatcatacgccatttcccgcttccagtcaagtctaaaattgttaaaaaagttcttcaatttcttgtgtttccatcaatttccgcaccacagcatctggtagggtcccacacttttgccagaagcgccctcccgccggacacaaatttttgtgatgatattttgattttccaattgaccccgacggcgagttgtgtataatgagaatagtctaaatacgttcccaaatctgtacgtttttggaggaaatcagagatgtttgaatttttgatcaaaaagctgaaggcccatccccggaagattgtcttcactgagggcacggatccccgcattctggaggcgtccgcccgcttgctgtccggtaccttcctgacccctgtgctggtgggcaatctcgacgagatccaggccgctgccgaggaagccggcttcaacatccggggcgctgagatcattgatcccgaggccttccccgacatggagaagatggtctccaccctggtggagctgcgcaagggcaagatgagtgaggaggagtgccgcaagctcctcaagcaggccaactacttcggcaccatgctggtgaagatgggctatgccgacgctctgctgggcggcgccacctattccaccgccgacacggtccgtcccgccctgcagatcatcaagaccaagcccggcaacaagatcgtgtcctcctgcttcattctggtccgtccctctgccaccggcgaccgcgaggttctggccatgggcgactgcgccatcaacatcaagcccaccgaggatgagctggtggagatcggcctggagaccgccaccaccgccaaggtcttcggcatcgatcccaaggtggcttacctcagctattccaccctgggttccggcaagggcgaggatgtggacaagatgcgcaatgcctgcagcagactcaaggccctggcccccgatctggatgtggacggcgagctgcagttcgacgccgccgtctctccccgcgtggcccgcaccaagtgccctgactccaaggtggccggccatgccaacaccttcatcttcccggacatcaacgccggcaatatcggctacaagatcgcccagcgtctgggttcctttgaggcttacggccccatcctgcagggtctgaacgcccccatcaacgatctgtcccggggctgcaacgcccaggaggtctactccatggccatcatcactgccggcctgtgcgaggactgattgccgtacatcccattttccatacagcagacagcggcggacgctttcgcggtccgccgctgtttttttgttcattgcaaccggcggttgcggaatcgccaagggaccttgatggacaatcccgccgccctctgctatgatggtcgcagaattgaagcgggaggcgagaccatgaccttgggagaacggctgattcagctgcgggcaaaagcagggctcagtcaggataccctggcggagcagctgggagtatcccggcagtctgtcagcaagtgggaaaacgacgccagcgtaccggatttggagaagttggtgaaactgagtggagtgttcggcgtatctctggatgaactggtgaagggagaggtcccggattcggcggcccccgccgtaaaggccggcgtgacggcagaggaacttcggctccaccggcagaggctggtggggatcgcgttttttctttccgccgtggtgctctattcctatgcgctaaccgggccaatcgcggtgtggccgctactcatgtgcggaaccgcctgtttgttccgcaggaagtttttagccatcatctgcagctggggtgtatggctggcgcttttttcgatttttggccccagtttgatgtggcttccttccggcaactctgtcacctggatggccgccttctggctgaccattgcgttgttgttcctgacggttcaaaccattcgccgtcccccgcccgtccctgtttgctggctgcttctggtcgcctttgcgctccaatatgccggtacccgcagcatttggacgtccatccatcgtccgggtctgctccagttctttctgcttcgtcctggtggaaagttcctgatactgtattggttggtgatgcttcttctggtgtccgtccataccatacgagaattcgttgtttcccaccggcattccaccgggaatctatccaaatcgtaaatttttttgcaataattccttttcgtattaaaaacaaagccgccctgtcgggcggctttgcgctttgctttcgctgcttacttcaggttgaagaacgccttcatgccaggatactgcgccacgtcgcccagctcctcctcgatgcggagcagctggttgtacttagccacccggtcggtgcggctgggggcgccggtcttgatctggcccgcgttgacggccacggcgatgtcggcgatggtggcgtcctcggtctcgccggagcggtgggacacgatggcggtgtagccggcccggttggccatctggatggcgtccagggtctcggtcagggtgccgatctggttgaccttgataaggatggcgttgcccacctgcttctcaatgccggtggccagacgctccacgttggtgacgaacaggtcgtcgcccaccagctggacccgatcgccgatggccttggtcagcatggcccagccctcccagtcggtctcggccatgccgtcctccagggagatgatgggatagttgtcggcaaacttcttccacatgttcaccagctgctgctgggtcagcttcttgccggacttgggctggacatagcacttctgctcctcgtcccaccactcggaggaggcggcgtcgatggcgatcttgaagtcctcgccgggcttgtagcccgcggcctcgatggcctggacaatgaccttcagggcgtcctcatccttcttcagattgggggcgtagccgccctcgtcgcccacaccggcagcgggagtgccgttctccttcagcacagccttcagggcgtgaaacacttcggcacagcggcgcagggcctcccggaaggagggggcggagacaggcataatcatgaactcctggatctccacattgttggtggcgtgggcgccgccgttgaggatgttcatcataggcacgggcagctgcttggcgttgacgccgccgatatagctgtacaggctggcgcccaggctctcggccgccgccttggcgcaggccagggacgcgcccaggatggcgttggcacccaggcgagacttgttgggggtgccgtccaggtcgatcagggccttgtcgatggaggtctgatccaggacattcatgccgatcaggcactcggcgatctcggtgttgacgttctccacagccttttccacgcccttgccgttgtagcggcccttgtcgccgtcccgcagctcgcaggcctcatagataccggtggaagcgccggagggcacggcggcgcggcccatggtgccgtcctccaaatagacctccacttccacagtggggttgccccggctgtctaggatctcccggcccaggacgtcgacaatctcaatgatctgcttcatagaactcgtactcctttattaaaattataagacagaatcatgcgggcgcgttcctcccaagggagggcccaccagggatttccggtgctattatatcggtaatcgtttactctgtcaagcaaaccggatatttccagtgaaaaaagtgcgcactcctgtcacagaaggacggcgctgctgagaatctcaaaggcctcctgacagggcaggcgctttttctccatgggcggcaggctgtcgtcaaaccggcgggcttccgcttcgtcaaacacaaacgccgggctctggcggtatatccagctttttcccgccagggtgccgggctccagttccttcaccagcatcgcggcgggatacgtcccgtcctccagatggacccggtgctttttgcagctttggaagccgcggcccacgtagttgttgggatcgccgaagatcacaatagcctcgtaccccatggcggacgcccgccggaaggactcctccatcagcagcctgccatagccccggcgctgcagtcccggtcggatacagactggtccaaaggtcaggatgcccttctccttccctgcctcgtccaccagtgtgctcttcgtgtacatgatattgccgaccacacggccgtccagctccagcaccaggtccaactccggcagaaaatccgggtggggccggatggcgtgggccaggtagtgctccgtgcatcctggcgtgtagaggttgtaaaacgcctgccggatgatgtcctccacctgctggtaatcgctcacccgctccgggcggatcgtgatgttcttctccatatcggttcctccctgcatgaattggcgccctgcgggcgcagtctgcacagcttgtcctgctctctattatatgtctctttcggctgcacgcaatggtgggcagtgatttttttcgtccggagtgaaagctggcgcgaaaaagcgcctcccgcaaaagcgggaggcgccgaatcgaaaactcacaggaggttcatcaggttgaagctcaggatcaggccggagaacacgatggacaccgtggagcacagcttgatgaggatattcagggacgggccggaggtgtccttgaaggggtcgcccaccgtatcgcccacgacggcggccttgtggcactcggagcccttgccgccgtggtggccgccctcaatatacttcttggcgttgtcccaggcaccgccggcgttggacatgaacaccgccatggcaaagccggtgacggacacgccgcccagcaggcccaccacgccggtggggcccagcaccaggccggtagccagaggcacgatgatggccagcagggccggcaccaccatctcatgcagggcgcccttggtgcacagggacacgcaggaggcatagtccgggtctgccttgtactccatgatgcccgcgatctccttgaactggcggcggacctccaccacgatggactgggccgccttctgcaccgcgctcatggtgaaggcggagaagacgaaggtcagcatggcgccgatgaacatgcccaccagcaccgtggggctggtcagggtgaagttcagcatctcctccgtgttctcctggacgatgttcacgtagctgaccagcagggccagggctgtcagggaggcggagccgatggcgaagcccttgccggtggcggcggtggtgttgcccagagagtccagtgcgtcggtccgctcccggacgctctccggcaggccgctcatctccgcgatgccgccggcgttatctgccacggggccgtaggcgtccgtagccagggtgatgcccagggtggacagcatacccacgccggcgatgccgatgccgtacaggccctggttgaaggccgcagtaaaggcgccggcctcatccacgatctccatgctgccgccggcggcgaagtagctgaccagcaccgcagccgccacgatcaggatggaggtcagagtggacttcagacccagggagatgccgccgatgatgatggtggcggagccggtctcggaggcggccgccagctcctgagtgggcttataggtatcagaggtgtaatactcggtgaagtagccgatggcgcagccgccgatcagaccgcagaggatggccacataaacgcccatgtgcccatccagaatgaaataggtcaggggcgccgccaggatggcggagagaacagcggcggtgtaagtgccggtccgcaggctcttcagcagggactgctgggtggcgttctccttagtcttcaccaggaaggagccgatgatggagcagatgatgccgcacacggccagggccacgggcagcagcaggccgccccagccgtagccgcccacagcgcccaaggcgaaggttgccaggatagagcccacatagctctcatacaggtccgcgcccatgccggccacatcgcccacgttgtcgcccacattgtcggcgatggtggcggggttccggggatcgtcctcggggattccggcctcaactttgcccaccaggtcggcgcccacgtcggcggccttggtgtagatgccgccgcccacacgggcgaacagagccatgaaggaggcgcccatgccgttcatcaccatgatattgcccagggacaccggatcattgatgccgaaggcatagcgcagcaggaaaaaccagatcgtgatgtccagcattcccaggcccaccacggtgaagcccatgacggaaccggaggagaacgccacccgcaggcccttgttcaggctctcggaggccgcctgggccgtccgggcattggagtttgtggcgatcttcatgccgatgaagcccgccagcatggaccagatgccgccggtgaggaacgcgaagggggtgaactgcgagagcatcttcccgccggaaccgaaagcaataatcagcaggaggatgaacaccaccagaaacaccttgaacactgtggtgtactggtgcttcagataggcgtttgcgccctcacggatggaggcggcgatcttccgcatcttctcgttcccctccgagaaggacatcacgcggctgcgctgcagccacgcgaagagcagtgcgatagccgccccgacaaatccgatccagaaaaggtcttccatgtttctccgctcctttgcagttgtatttgtatacggtacgtatattttaacatagcccggaaatttttcaagaaaatattaggtaattttgcgtgcagacagctacgttttcgcgttttccacaaagttcctgttttttggctcccacttttcattcatttgggcagattgcctctttacaggacgcctgacctgaaatccggcgaatttttttgtgaaaaatgccctcaaaccgcagtctgagggccgtatacagcaatatggttctgattttgagctgcaacccatccagctctgctcaatagatcaagtggaaatcggtgaagacccagcggtcttccagaaattcataggggaatgcataggactccacccctgtcacggtagagccgccgtctgccagcagatccacctctactatgacagagtatcccgcctggccgtacggcttgatctggatgtccgcctgacccttggactcgtcccgctcccggctggtaggcagaacatacagggccccgtccacatcctgatacaggggatgggctccgccggaggccagcagcgcatccaccagctcctctgaaaacaggccccgcagataggcccgcaggtctgccagattttccatgcccgggtactccaccggatagtaaagccagccgtctatggtctgcgtcttctctccgcagggcagcgtctccaggctgaaccagccgtacgcctcctccgcccggaaataggccgcctggatctcctcgtccgtcaggggacgggcctgaccctccagcctgacggcggacagaccgccctccgcatccggtgcagaggcctccgcaaaaacggaaggcgcttctcccgccgccccctcgtccgcggcgggcccgccgcacccggccagcgcccacagcgccagtgccagaaacagcacgctccacctcttcatagcttcctctctccttctcccaaacgggccgccggcaccgcagggcccacagccgtaaggctctcctctctggtatcagcgtatcacagttttcagaaaaatgccattcattttttacttttttccgttttttcgacagttttttgaaaaagccgcaaaaatgccgcccggaacattccaggcggcagaggagatcggtctccccggggaactgcatatcgtcagcggagcgaaccacatccgcggaaactgtcaagcgccgggccgaaaaaagaaaaatccacgcctccggcgtggctctccatcggattccgttctcaccgctcgctgtgcttccagccggcgtccgtaaagatcaggtcgtccacatcgtcgagatcccgccaattccaattcatcatactgctccctcctttctctctgaggattacagaattcagtatagcagggtgggcagccgtctgcaagggcaggaatatacagtttacataaaatttttgcaaagtttttgtgcaggattcttctcccagtaggccgaaaccatacggaagccacccgccatttccgtcttctttgtgtatttttccactcgtcatatccatactatttatggtataatagccgcgaagcggctattatactggccgggcatctgctccgcgcctgcggaggcgcctttttgcagcgcccgcgcttcctacattcggatttgctttttccacgtctcggacgtgctgcgttccgcggcggaggaggccgcgttcaccatgcccaagcatcccaagcgccgcacccggcggaacctggccgtgctggccctgtccgccctgtgcctgaccggatttctctactgggacaacaccgctctgcaggtgacccggtttgaccctgtcttttccgatctgcccgccggttttgatggctgccggatcgtggtcctcagcgacctccacggcgcctcgttcggtgcgcacaacgcggacctgctggcggctgtggccgcggagcagccggagtacatcttttttctgggggatctggaggacaagtaccgggggccggcggacggctacccggcggagaccgcccggggactttctgccattgcccccacctactacgtcaccggcaaccacgagtgggccgtgggcggagtgccggcgctgaaggaaatcctcaccgccaacggcgtcacggtgttgtccaaccaattcgtgcccctggagcggaacggggacaccattgtcctggcgggcatcgacgatcccaacggctacgccgaccagaagacgccggaggaactggccgccgaggtctacgccgcctgcggcgaccccttctggatcctgctggcccaccggaacaaccggtttgcgcgccagtacagcctgctgggggcggatctggtgtgctccggccatgcccacggcggcatcgtccgcctgcccgggacggacgggctgttctcccatgacctggacctgtttccctcctataccgccgggctgtatgaagaaaacggctccgtgctgttcgtcacccggggcctggggaattccgggccctccttccgggtgttcaaccgcccggaaatcgctgtgctgacgctgcgccgggcggagggctagtcccggcggcaggcttccgagcgccgcaggcccagggcaaggccctggcaaaagcagaacagcccatagccccggaccgggtcctcccgcagatactccggccactggcccgggtccggagccgggccccaggcgaggaagagttcttccatgatatcaggtatttcctgcatgataaatccccttgcaaaaaatacagttatatgtactatcattagaatggtacatagttatctgtgtgtcaaggaggtattgcatgttttccgagaaaattcgccagctccggaaagatcgccatctgacccaggcagaggtggccaaggaggtcggcctgtcagcccggggctatcaggacctggagctgggcgccaagccccggtatgacgcgctgctgcacatcgcggacttctacggcgtgtccgcagactggctgatgggccgcacggacaaccctgctgtgaatcgctgaaaaaggaactgcgggaggtccaatatgtttgccgataaaattcgagtccttcgtaaagagaaaaagctgacccaggcagaagtcgccaaggaggtcgacctgtcagcccggggctatcaggacctggagctgggtgccaagccccggtatgacgcgctgctccacatcgcggacttctacgatgtgtccgtggactggctgatgggccgcacggacaatccccatgcacaccgatgaaaggatttccaccttatgaccgaattcctcgccggacaatttgatatcgccgtgatcggcgcgggccacgccgggatcgaggcggcgctggccgccgcccggctggggatggaggccatcgtctttaccatcaacctggatgcggtgggcaacatgccctgcaaccccgctatcggcggcaccggcaagggccatctggtccgggagctggacgccctgggtggcgaaatggcgaaggccgccgacgcgtgctgcatccagtaccggctgctgaacaagggaaagggccccgccgtctggtccctccgggcccaggcggaccggcggcgttatcaggagtacatgaagcacaccctggagcagcaggaccatctgacggtccgccagggcgaggtggtggaggtccgcacggagaacggcgcggtttccgccgtggtgctggccaccggggcggtgttctccgtgaaggccgtgatcctggccaccggcacatatctggcgggccgcaccatcgtgggcgagtgcgtggaggaatccggccccgacgggatgcacgccgccggacggctgacggactccctgctgaagctgggcctgcccctgcggcggttcaagaccggcaccccgccccgggtcaacgccaggagcgtggactttgacgagatggagctccagcccggcgatgccttgccggtccccttttcatacggcacccaatccccgccggagaatcgggcggtctgctggctcacctggaccacggaggagacgctccggatcgtccgggagaatctggaccgggcgcccatgtactccggcgtcatcgagggggtgggcccccgctactgcccctcctttgagaccaaggtggtccggttcccggacaagctccgccaccagctgtttgtggagcccatgggcctcaacactgaagaattgtacatccagggcttctcctcctccatgccggaggaggtgcagatccggatgctccgcagcgtgccgggcctgcgccatgccgtgatgacccggcctgcctacgccatcgaatacgactgcatcgaccccctggccctgcgccccactctggagtgcaaggctgtgccgggcctatacggtgccgggcagttcaacggttcttccgggtacgaggaggcggcagtccagggctttgcggccggggtcaacgccgtgcggaagctgcggggcgagtgcgatttcatcctctcccggtcggagagctacatcggcaccctcatcgacgatctcgtcaccaagggcaccaacgagccctaccggatgatgacctcccgcagcgaataccgcctgctcctccggcaggacaacgccgaccagcggctgacccgccgggggtacgacatcggcctggtgccggaggcgcggctgcgggccgtggaggcaaagtacgacgccgtggcccgggagatcgcccggctgacccacaccggcgtctccccctcccccgccctggcctcctttctggcggacaagggcacggcggacgccccggacggctgtcccctggtcgccctgctgcggcggccccagctcacctacgcggacctggcccccttcgacccggaccggccggacctgccggcagacgtggcggagcaggtggagatcagcgtgaagtacgaggggtacatccagcgccagcagaaacaggtggaggacttccaaaaaatggagcggcgccgcctgccgccggatctggactattcctccatccaggggctgcggctggaggcccgtgagaagctgaacgccgtccgcccggcggacctggggcaggcctcccggatctccggcgtcagccctgccgacgtgacggcgctgatgatctatctggagcggtagtgcggcgcctgcccctgctccactcccagggccaggcccagctggaggcctctggcaaaggccgcggtacaccattggagacgcaggcccgccacctggtcgaacaggccgaggcggatgtcctccggcgcggcggccagcacctcctccagcacatggtcctggaagagcggctcctggcacagcgccgcctctgcgtactcgtcgtagagccattcgtaaatttctttcacaagcgccctcctttcacgatattatatatcgtgtttattgtaacacgagatcttgtatcagtcaatagaaagggacccctctatggatgtgattctgcctattttttcccagcgcctgaagcagctgcgcagggaccgcaagatcacgcagaaggcgatggccgagctgcttggaaaaaccgagcgccattatcaggcaatcgaggccggatgcatcaacgtccccgccacacagctgatctttttggccggatattttcaaacaagcgtggactacctgctgggcctctcggaccagcggtgacccgctctcccagaacttagaaaaagcaccatgccccgccgcatggaaggaaaggaagctcccgcccatgattatcgacctgacccacaccatcacgccggagatgcccatgtatcccggctccgccgccccctccatcaagcccaccggctccctgacccgggacgggttccgggagacccagttgaccatcgcctcccacaccggcacccacatggacgccccgtcccacatgcttccccggggctctacgctggaggtgctgcccgcctcccagttctgcggccgggccgtggtgctggacgtatcggacctgccgcccggagcgtcatcaccgccgactacctccgggagcagaacgggaccatccgctcggcggatttcgtgctgttctacaccggctgggagcggaagtggggcaccggcgcctattatgacgacgatttccccgtgccggaccaggaggcggccaaatatctggtttcctgcggcctcaagggcgtggggaccgacgccctcagcgtggacaccctgcgggatcagcagttcctggcccacaaaactctgctggacggcggtctggtgatcctggagagcctgtgcctgaaaaaggtcgtggggcgcaccgacctgatgcttttcgcactgcccctgaaatttgagaacgccgacggcgcgccggtgcgcgccatcgcggaattccgggacttcccggaggaaaaggagatggaggcgctttgagaaagtttctggccatcctggtgtgcaagctgggccgcgccgtgggcaagctggtgggcaagggcagctctatgcccggcaaattcgccctgaagatctgccccgatatcctcgcccgggtccagctgcccagccacatcatcgccgtcaccggctccaacggcaaaacctccaccgtggagatgatcgccgccatcctgcgggccgggggcaaaaccgtggtctacaatgaagagggctccaaccagatcgagggcgtcaccacgctggtgctgacccacgcgtctctcacgggccgggtgcgggcggatgtgctgctgatcgagtccgacgagcggtacgcagcccagagcttccgctacttccaccccacggagttcgtcatcaccaatctctaccgggaccagctgacccggaacggccatccggagtgggtgtatgacgccattctcccggccctccatccggagacggagctgatcctgaacgccgacgatcccctgtccagctgctttgcccggggacgggacagggtgaagtggttcggcctggaccgctgcccctccgacaccgcgtcccccaccggcgtgtaccacgacggggcctgctgtccggtgtgccatgcccccatggaatatgactacgtccactacaaccacatcggcgctttccgctgcacgaaatgcggccatcacaagcccgccacggactacaccgccacggcgctggacctgggccggggcaccctgaccatcgacagctccatcaccatccagctggccttccgcagcatctacaacgtctacaacatcctggcggcctatgccgcctgccgggagtgcggcgtggcggcggacaccgccgccggggtcatcaacaactacatcctgaagaacggacggatgcagaaattcaccctgggggagcaccgggggatgctgctgaccagcaagcatgagaactccatcgcctacgacacgaacctccgctacatccgcgccgcccaggagccctgcaccgtcctggtgatcgtggacgcggtgagccggaagtacttcaccagcgagaccagctggctgtgggacatcgacttcgaccagctgaacgccccccaggtgcagcggatcatcctctccggccggtattgcaacgatctggcggagcggttctccttcacggacattccccgggaaaaggtcacggtccaggcggacatccccgccgcggcggcggagctgaaggcggacggcagtgaaaacgtatacgtggtcacctgcttctcggaccgggacaagattctctcccaggtggtaaaggaggcgtgaggacatggaactgaagatcatccacttttatccggatctcatgagcctttacggcagctatgccaatgtgtccgtcctgcggcggtatctggaggccctgggctgcgccgtcacggtgcaggccgtcatcccgggggagggcgcggacatcaccggcgccgactttctcttcatgggggccggcacggagcgggcccagcggtttgcggcggaggacttcgcccggtacggcgcggcggtgaaggccgcagcggaggacggcaccgccatgctgttcgccggcacagctatggagctcttaggcgcctctgtcaccgacagggacggggacacgtatcccggcatcggtctggcctctttcaccacggtccagggcaagcggcggatcgtaggggatgtgtacggcgttacagccctgtttccggaggccgtggtaggcttcatgaacaagtgcggccaaatccgcggcgtggaggcgccgctgctcaccggtctctctctaggcttcggcaatgaggcggagaagggcccggagggcttccactggaagaacgtgttcgcctctgagctcaccgggccagttctggtaaagaacccccggctgctggaggctgtggcggacgccatctgtacccggcggggcatttccctgccagaggagcggccgtccttcccctatgcagaggcgggctacgccatcacagcagagcagttgaagctgcgggccgaggcccggcagtgattgcagggagaatccgccaggacggccgcctgtgggcggccgtcctgttttttgcagaggcccgccggggccgtgcgcatccaactccagccacagactgacgcagggaagcgcgaccatgggggacattgcccggaaaacggaccggggagcggttgcaagccgctccccggtcttattttattccgtattgcttaaaacctcattgtgcttatccaccacgctgatctccaaatcccggtaatccgcggtgttcggctcctccgtcacccgcagcagccagggggcctcatactccgtatccagcagctgcccattctgtgtcaccacacagtaaggtgtaaaattctctcccaggatgaaccagtcccccgcccgctgctccataccggtgatctcgatgggcaccatgcccatctccatctccgtgggtctgtagcgggcctcgccctcatagcagtatccttttccatagagggcgtcatattgcagcatccgcaggtccgcccggtatgtaggctcctcccggcaggtctgctggaaggcggtcatcagcccggtggtgatgcccaggcggcccagcacagcggcggagagctgataggccgccaggggctcgtcctgctgttccagcccaaagttgtcccagatgatgtactctgtgcggtagaggctgctgctctccatgttctcggcctccagccccagcgccggcaggtggtcgccgtagagcaccagcaccgtccgctcgtcccgggcctccagctcctggatcagatcccccacaaaggcgtccatctcatgaatctggttcacataatactccaaagcccagcggtacgcctcatcggggcacgcttccaccgtgacggccgggtcctccagctccggctccatggggtatttgccgtggccctgcacagagaccgtgaacaccagatccgcctggtcctccgtcacatccagcgcctggaggatctggtccttcagcacgccgtccttagcccagttggtgggcgtcttctccaccgcaggcatatactccagggcggtaaaatcatcaaagcccagattgggatagacctcgttccggctgtaaaaggccgcccggtgattgtggatggcatgggtcgcgtagccgttttccttcaggtcgtaggccacagactccacggtctgatccttcaggcaggtctggaaggggtactccccgggtccgaagaaccggctgctcataccggtaagcacctcgaactctgtattggctgtgcccgcgcccaccaccggcaccgtcagatagccggaggaatacgcttccttcagcgccgtccagttgggcaccggatcctccgacagctccaggccctggatcatggatggatcaatataggactccagctggatgaagatcacattcacatccgtctgcggatcggcggagagcgccgccgtcttctcctccaccgaccggacaatatccgccaccgccttctggctgtaattggccgggcggcggatcccccggttcagccaggtctgcaggaagcagtaggaaaagccgtagtcctcgtaggcaaaggccaggttggcaaactggtctgacaggttgcctgtgaaaaaggccagggcgcatccgccgcccatcagggcgccggagaccgccatcgctccgatgccggtgagaatccgggtccgcagcggacagctgctgcggggccccttccagaacagcagcaccagccctgcggccaccagcaccagcgccgcgatcagcagaatgatgtagccggtggagagatagttggggaccgtgtccagccccgtttcaaacaccgtcagatccgccacggtgaagggcgtcatacggttgaggaggatgaacccgttcacgccgccgcagatcagccacaagaaggacaccaatgcgcaccagaacgcccgccgccgcagaaaaaaggcggggcagagcgtcagcagtacaatcaggaaattcaccagaaatgccagcggttcctccgtcataaagcgccaaaagctggcgggcccatctgtgaagctcttgtgattgaacagctccaccacgacggtgaccgctaaagccagcagcggaagatacaggaacgctctgcgttcctgtcgatgccgttcggcatccgcggccgccggcggcaatgtctgttgcatcggaatgaccttctttcttttcatagattttttattatagcgcctttccctctgcaattccatgaattttttgcgaacttttttctttttcttttctaaaatttcatctgattttgaagaaagtctccctgctccatcgtattggaaactgcggcggaaacctcttgacaggcggccccgtttgtattattgtactatcgtaatagtacattgagaggagcggatttcatttgcagcagcgatccaagttcattcaaagaaccagcgctctggcgctggcggcggtcctggcactcggcatgggtgttcaggcggccggaccgggcgcatccacagtggatgaccggcgggaggacctgaccatattttatgagacgctgaaagacagccatccggatctttttgccaacacgccggaggagaccttcctggcccgcaaagcagagcttacagagcatctggacagcgcaagcgacgtagaatttctcttcggcttgcagagtctggccgcgcttgtgggcgactcccacaccagcgtccaggtggcggacagcgtggtggaccagctgaatgcctatcccatggtgctgtcctggcgggacgggcactggtacctgaccacagttccggctgaggaacaggatctgctgggcgcggaggtcaccgccataggcggccgctctatggcagaggtggtgaagacctttggccgcgtgctcagtgccgacaacccggtgaagctgcggcggcagtaccggcaggtgtgcaatgtggcggattactacgcctatctgggtctggcaaaggcgggtgagcctctggccctcaccctggctgacggcaagaccgtctccatcgctcccatgccctacctctccctgggagaggcggaaattgtccagctaggcgctgaggtgccccagcccgccactgcccgccagaagtgcaattactgcgcacttccgctgagcgggcaggtctactatatccagtacaacgtctgccaggaggacccggcgctgcccatggagggctttgccgcccaggtgcaggcggacctggaggccggaagttacagccgcgttctcgtggacctgcggaacaacggcggcgggtcagacggcgtaatctggcctctgctgtccgtcctgcggcaggagatggatgatgggaccgaggtggtgggactcatcggagaggccaccttctcctctgccatcatcaatgccgtagagctgcaggaaatgggcatcccgctggtgggagagcctgccagcggcagcgtggaccactttggctccgccagtggcttttctctgcccaactccggcatccagattggtgtctcctccaaatacatcgacctgggcaccctgctggacgccgacgccggacggggcgtggagtctctggagccggatatcgccgttccccaaaccatggcggataccctggcgggcagagacaccgctgtggagtggctgctggcccatccggagacgctggaacagcgggaatacccggatgcgccgctcacccgggggcggttcgtggggcagctgtatgctgcggccgggtcccctgccgcagcggcggaggccggtttccaggatctgctgggcatcgagtggttcctgccggcggtgaactgggccgcggagaccggcgtcaccggcggtacggcggagggcgcctttgcggccgcccggcacctcacctggcaggaagccgccgtctttctcgtccgcactgcggaggccctggggctggagccggaggctgtccgcaccgcgcctctgcccgatgcgctggcggagggtgcctgggaccaaaccgctctggaactggcctgggaatggggcctgcttccggaagacgcgggcagcgccgccgaaatcgctcgggtccagggcggggccatggcggatacctttgcggccctgctgtaaccccacgaatcgtctgaccagaaacagcccccggacgctgcggcgtccgggggctgtctcaacctctctgacggcggtgtgccgctgttctctgacgggctgtcttccaggcgcacgtcccggcagagaaaaggaccgcgggataactcccgcggtcctctgatatggtatatgcttactcgctgtacatggccttcagcttcagcaggtgctgatagcgatccatggcagctttctcgttgcgctggaacagctcgccggcgcggtcggggaactcgcgggtcagacggctgtaccgggcctcgttcatcaggaactcctgatagccgccagccggctccttggagtccagcgtgaacttggcaccctcagcggcggggttgaagcggaacaggttccagtagccgcactccacagccttcttcatttccttctggcagttcatcatgccgcccttgatggagtgcatctcgcagggggcgtagccgataatcagggacgggccgggataagcctcggcctcctgaatggccttcagggtctgggcggggttggcacccatggccacctgagccacgtagatatagccgtaactcatggcgatctccgccagggactttttcttgatctccttgccggccgcggcgaactgcgccacctggccgatgttggacgccttggaggcctggccgccggtattggagtacacctcggtatcaaagacgaagacattcacatcgttgccggaggccaggacgtggtccagaccgccgaagccgatgtcgtaggcccagccgtcgccgccgaagatccacatggacttcttggacaggaactccttgtccgccagaatctcagcagccagcttgcaggcgtcacactggcacagcgtctcgccctttgccttcagctcctcgccgaaggcatggatctccgccttgggattggccagcagctcgtccacagtgcagatgctgctctccagggcggcgatgtatgccttggtggcctcgccgttggcggcgctgtcctccatggtgtccagccacttctggccggcctccttcagagcgggcactgcccaatccttggcaatcagctcccgggtcagatccgccagacggctgcgggtggcctgctggcccagatacatgcccaggccgtgctcagcgttatcctcgaacagggagttggcccaagcgggaccatggccttccttgttggtgcagtagggagaggtggcagccggaccgccccagatggaggagcagccggtggcgttggagatgtacatccggtcaccgaacagctgggtaatcaggcgggcatagctggtctcggcgcagccggcgcaggagccggagaactccagcatgggctgacggaactggctgcccttgacggtgttgtcctgcatgtccttcttctcggacacctgggagacgcagtagttgaagacctcctgctgggcggcctcctgctcctggtccaccatggtcagggcgtccaccgggcactggcccacgcacacggcgcagcccatgcagtccagcgggctgatggccatggtgtacttgtacacgcccttgcccttgccggccttcacgtccacgatcttggcggcggcgggggcattcttggcctcctcctccgtcagagcgaagggacggatggtggcgtgggggcagacataggcgcagttgttacactggatgcacttggtggaatcccaagtgggaacggacacggccacgccgcgcttctcataggcggcggcgcccagctcgaactggccgtccacatgcttgacgaaggcggacacgggcaggctgtcgccgtccatgcggcccacggggtccagaatcgtgctgacctgctccaccagagcggcggggccctcgtgcttgacgggctcggcctcgtccacagcgttggcccagtcggcgggcacatcgaacttcttgtaggcggtggcgccggcgtcgatggccttgtggttcatgtccacgatgtcctggcccttcttcaggtaggagtgggtggcggcgtccttcatgtagcccacagcctcgctctcaggcatgaccttagccagagagaagaaggcggactgcaggatggtgttggtgcgcttgcccatgccgatttccttggccaggtcgatggcgttgatggtgtagacctgaatgttgttcttggcgatgtagcgcttggaggcggcatccagatggtggctcagctcctcgtcgctccactggcagttgatcaggaacacaccgccgggcttcacgtcccggacaatggggaagtgcttggtgatgtaggcgggcacgtggcaggccacgaagtcggccttgttgatgtagtaggaagacttgatgggggagtcgccgaagcgcaggtggctgatggtgacgccgccggtcttcttggagtcgtactggaagtacgcctggacatacttgtcggtatggtcgccgatgatcttgatggagttcttgttggcgcccacggtgccgtcgccgcccaggccccagaacttgcactcaatcgtaccggcgggagccacgctgggagcgggcttctcctccaggctcaggtgggtcacatcgtccacgatgccgatggtgaactcgcgcttcatggaatccttcttcagctcgtcatacacggcgaagacggaggcgggcggggtgtccttgctgcccaggccgtaacggccgccgatcacctggatgtcggtccggccggcgttggccagagcagtgaccacgtccatgtacaggggctcgccctgggagccgggctccttggtgcggtccagcacggcgatcttcttgcaggtggcggggatggcggcgagcagcttgtccgcacgccagggccggtacagccggaccttgatgaggcccaccttctcgccgcccgcattcagatagtcgatgacctcctcagccacgtcgcagatggagcccatggcgatgatgacgcggtctgcgtcggcagcgccgtagtagttgaacagctgatagtcggtacccagcttctcgttgatcttgcccatgtacttctccaccacgtcgggcagagcggtgtagtagctgttgcaggcctcacgatgctggaagaagatgtcgccgttctcgtgagagccgcgcatgttgggccgctcgggattcagggcgtgcttgcggaacgccgccacggcgtccatgtcgcacatctccttcaggtcatcgtaatcccacacggcgaccttctggatctcgtgagaggtccggaaaccgtcgaagaagttcacgaagggaacgcggccctcaatggcggccagatgggccacgggcgccaggtccatgacctcctgcacgttgccctcgcacagcatggcgaagccggtctggcggcaggccatgacgtcggagtggtcgccgaaaatgttcagggcgtgggtggacacggtacgggcggacacatggaacacgcagggcagcagctcgccggcgatcttgtacatattggggatcatcagcagcaggccctgggatgcggtgtaggtggtggtcagcgcaccggcggccagggagccgtggaccgtgccggaggcacccgcctcggactgcatctcgacgaccttgacagtggtgccgaaaatgttcttctgaccagcggcggaccactggtcgaccaagtctgccatgggagaggacggggtgatgggatagatccccgccacttcggtaaacgcatagctgacatacgcagctgcgttgttaccgtccatggacttgaactttcttgccataaacttacctcctataaatgtgctgcccacacgacagcattctgaaccaacatgaacacggtcgcattcccccgaatgctcatgcagtgttattatatcacttgaaatttgccgtgtaaataactgccttgttattttttgcgcaaattttctggtttctgcggaaacgtcaagacttcctggaattttcaggccagttttggaatccggggtttcttatttcgtcgttttgtggtaaactgacttccgtgaaaacggcggttttcgacaattcgcaatcggctcttccggcagcgggcggcagcctggagcgggagggcttctggaggtggtcgtttatggtggtgacggtgcgctccctgggactgaacggcattgccgggtatgcggtcagcgcggagtgcttcctctccggcgggctgcccgcctttgacatcgtgggtctgccggacgccgccgtgcgggaggcccgggagcgagtccgggcggcggtgaagaactgcggggccaagttccccgtcagccgaatcacggtgaatctggccccggccgggcagaaaaaggcgggcacagtctacgacctgcccatctttgtggggctgctggccgcaggacgggagctgccgccgccggcccagcaagcggcgtttatcggggagctgtccctcaccggggcgctgcggggcgtcaccggcgtgctgcccatggccctggcagcccgggacgccggtgtgaaggagctgtatgtcccggcggagaacgccgctgaggccacgctggcaggcggcctcaccgtctacggcgtaccggatgtaggggcgctggtgcgccacttgcggggcgaggagcgcctctcccccgcctcggcctgggtgccggaggcagaggaggccgccgggccggatctgcgggatgtgatgggccaggaaaatgccaggcgggccctggagatcgccgcggcaggcggccacaacctgctgctgatcggctcccccggcgcaggcaagtccatgctggccaagcggctgccctccatcctgccggatatgagccgggaggaggcgctggaggtctccggcatctggtccgtggcggggctggcggacccgcagcaccccctgctgacccggcgccccttccgcagtccccaccacaccgcatccgccgccgccctcactggaggcgggccgctgctgcggccgggggagatctccctggcccacaacggcgtgctgtttctggacgagctgccggagttccaccgggacgtgctggaggccatgcgccagcccctggaggacggcacggtgacagtggcccgctccggcgggacgctgcacctgcccgcccggttccagctggtgtgcgccatgaacccctgtcggtgcggctggcgagggcacccctccgggcggtgtacctgctcggaccgggaggtggccaagtatgtggagaagatctccggccccctgctggaccggatcgatctccacgtcagcgttcccgcggtggaatacgcatccatgcggcggaaagagactccggagagctccgccgatgtgaagtgccgggtggacgcggcccgggctgtccagaccgcccgctttgccggcaccggcgtcacctgcaacgcccacatgaccgcccccatgatcgggcagttctgccgcctggaccacgccggcgatgcgctgatgaagtccgccttcgagcggatgggcctcaccgcccggtcccatgatcggattctgcgggtagcccggaccatcgcggacctggacggtgcggcggacatcaggccggagcatctggcagaggccatccagttccggaataccgatattttgaagggataaccgggtccccgccgcagcccagcgcagcggactttacgggggcaaggcggaagccattccgttccggaaccggacattcccaaaggatcagaaaaccaggcggccccggaatggggccgcctggttcactgtggcggaaataacgtggtcagtgccggttccagagaagcagggccgccagcagcggcactcccagaagcaccgctgccaatattatggcgaagatccgggcccttttgcggaacccctccggcgagtaatccatatctccctttttcaggcggtgcagccagaacgtgttcaggccccagatcaccaggccgatcaccggtacgatcacaaaaaccgaaaaccatccgtctccgttggaaccataatacagcgggctcattctccagattcctccttccgccaatcgccgactctcctctttaccggatgaagttcatcatgggacggggcgtgctctccggcacagggaccctgctctccgccagcaccttcaccatccaggccatatcccggcccaggcgggcggccacctccatgccctcctcgtctttcagggcctcgccggggtccgcgccgtgtacggcgccccagtagtcggaggtgacgatgaccatctccatggcatccatggtgcccagcagctgctgatacgtctccatgccgccgctgcggcgcagggtgcacagggcgccccccaccttgtggtggagctgattcaccccgcagcccgccgccagcatcagccggtccagcacgcacttcatattgccggaaataccgccgtgatacaccggagctgccagcaggatgccgtccgcctcgatgcaggcggcgatgatgtcgttgaccatatcgtcggtctggacacaccggaggctgccggtgttcaggcagtggtagcaggccatgcagggatggaccttcgccccgggctggaacacctggaactccaccccggcggcctccacctcccgccggaccacctccagcacctgggcggtgttgccgttctttctgggactgccgttgatggccacgatcttcataaacttcccctccataatttggtttccccctgttgtccctccattatagcagagggctggacggcgggcaagagctccttttcccccataaaaagagacgccctgacgggcgtctctttggggctctggggaagatcaccagcggtcgttgtcgatgtcccggctgaagatggtcccggtgacggcgtcgatctcaaattcgtactcggtccagccgttgcggatctcgacttcatactgcgcccggccgtcatcccagtcaaactggcacttcaccaccgtggagccgctgggcgtctccgccagggcgatctgctgggcccgctctgcggtgatatagtcaccgctggaagagttgctgccgttcccggaggggcggctggtgccgttgttccagatctggaaattctccagctcccgatcggagctgaggatggcgccggtgacggcgtcgatgtcgtagtcatattcggtggtgccgctgtaaaactccacctcatacttcatccggccgtcatcccagtccaggttggcccgcaggaacacggcgttggcctctttgacaccggcgtcattcagggcgatctgcttggcccggtcggcactgatatagttgccggaggcggaagaggcgccctgctggctggcggtccggtccgcggtggtcagctggaccgtgcgggtggccgagttgaaggacacgtccatacccatggcctcgctgatggcccggacggggacataggtggtgccgttgtagaggaacacggggacctgctttccggcggcatcccgcggggtgaatctggcgccgttgagggtgatgccgatgccgtcctccacctggatgctgcgcttggaggtggcggtggccgtgacgcacagtgctgcgatcaggaccgtcaggaccaaaccggagccgaagcccttccagaaaccgttctgcttcattgttcattctccttttcatgttctgcattcggcgggtctctcccgccccttctgcaccattaacggcgccagaagaggttttattgcaccgtgcggaaaatttttttatttttttcgcgccgctggcccttccctacaaaacaggctttctattcccggaaaaatgcgctataataggggccgatattccaaactgttctgatatggaggtccgttatgatgaatgcttcccctgccccgcaggagatctttttgctgaaactgggcgaggtggtcctgaagggacagaatcgccagtcctttgaggacaagctgctggccaacgtccgccgccgggtgaaaaactgcggcagcttccagtgctccctccggcagagcaccatctacgtggagccccagggagaggactgcgatatggaggccgcctgggacgcctgccgccaggtgttcggcattgccgccgtggcccgggccgtgccctgtgaaaagacagtggacgccattgtggaggccgcccggacctatctggcggacgcctttgccgttgcgaagagcttcaaggtggagagcaagcgggcagacaagatgtttcccatgaactccatccagctgagccaagctgtgggcggcgatctggcggagctgttcccccatgtggcggtggatgtccacactcccgatctgacagtatttgtggagatccgggagaagtacgcctatgttcatactccctctgttcccggcgcgggcggcctgcccatcggcatgggcggccgggcggtgagcctgctctccggcggcatcgactccccggtgtcctcctggatgatggcccgccggggcgtggagctggagatggtccactttgtctccccgccctacacctcccagcaggcccaggacaaagtactggagctggcccggctgctgactgcctggaccgggcggctgctggtccacatcgtccccttcacggagatccaggaggagatccggcggaactgcccggaggagtacttcaccctcattatgcgccggttcatgatgcgcatcgccgaggccatcgccaggaaggccaacgccggcgccctggtcaccggcgagtccctgggccaggtggccagccagaccatgctggccctgggggtcaccgaggatgtgacctccctgccggtgctgcggcccctgatcggcatggacaaggtggagatcatccgcatgtcccgggagatcggggtgttcgacacctccatcctcccctatgaggactgctgcacggtgttcacgccccgccaccccgccacccggccccggctggaagatgtgcggcaggcggaggccgccctggacgtggagtccctggtgcagaaggccctggcggacgagacctgggtgcgggtgaagtccacggatccggcccggatctgatccaatctgttcccggccccgccgcctgtcgccggcggggccgctgtttcaaaaaggaggtctttccatgtcacacaccgcggagatcatcgccgtcggcacagagatcctgctgggtaacatcgccaacaccgacgcccagatgctctctcagagcctgtccaccctgggcgtcaacgtcttctggcacacggtagtgggggacaaccctcagcgcctgcgggaggctctggacattgcccggcaccgggccgacatcattctcaccacaggcggcctgggtcctacctacgacgatctgaccaagcagaccatctgtgcggccttcggccagaagctggtgctgcacgaagatattctggaggacatccgggccttttatcagtccgccctccatgtgcccatgccggaaaacaacacccagcaggcggagctgccggagggctgcaccgtgttcgacaatccggtgggcaccgcccccggctgcgcctttgaagcggacggcgtccatgtgctgatgctgccggggccgccccacgagtgcgagactatgctccgccggtgcgtggagccgtacctccgcgccctctccaaagaggtcatcgtctcccacgatatcatgaccttcggcatgggcgagagctctgtggaccagctgctccatgaccggatggtccgcatggtgaaccccaccctagccacttatgccaagccctgcgaggtgcggctgcgggccaccgccaaggccgccggcgcagaggaggcggaggccatgctcgccccggtggtggcagaggtccgcgcggctttgggagactatgtgtacggcgtggatgtgaagggcctggaagcggtgtgcttccagctgctgaaggagcggaatctcaccctgtccactgcggagagctgcaccggcggccgggtggcggagcggatcactgccctgcccggcgtctccagcgtgtaccggggcggcgtggtcagctactggacctctgtcaaggcggcggtgctgggcgtgccccaggaaacgctggaccagtacggcgccgtgtcggaggagacagcccgggccatggcggagggcgcccggcagatcaccggggcagacatcgccgtgtccgtcaccggcgtggcgggcccggaccgggatgagcgggacaacccggtggggctggtgtacattggcctggccacgccggagggcaccttctgccgccggacggactccggccgccgccggcgggaccgcatccaggagctggccgccaaccacgctctggacgtggtccggcggtatctcaccggcctgcccatcggataagcgcgcacccaagggggcctgtggggcatatactggcctagcccttcagagaggaggcttctgtatatgcactattctcagggggatttctgttatcccccgtgttgtatcattcccactgttacggtgggcagcactgtcacgacaccccccggcacccgggcccgggtaaccgcctcgcccacgccctgcggtgtggagctggactttgccattccaaggggtaatccgggcccggctggaccccgggggccaatcggctgccagggaccggaagggcctcaggggccggaaggaccccagggaccggaaggacctcaggggccggaaggacctcaggggccggaaggaccccaggggccggaaggaccccaggggccggaaggacctcaggggccggaaggaccccagggaccggaaggacctcaggggccggaaggaccccaggggccggagggacctcaggggccgcaagggcctcagggaccggaagggcctcaggggccggaaggaccccaggggccgcaagggcctcaggggccggaaggacctcagggcccacaaggattccagggcccacaaggactccagggtccccaaggacctcagggtccgtcgggtattccggcctatgcgtcttttgtcacctaccagcaggagtttttcaacggcagctcaatctctttgagtgcggcagcaacggatgtgaccggccacattgtgcaggaatctaccactcagctcctcctgcaaccgggagtatatctcatcgcctaccactttgccgccaaccttctgaccgccggatatcttcaaatcacaccgggctacggaggacgcggtcatctggagtacggcgtctacaatcggaccggtatcgacaataccagtgtatccggctctgcctctttcatcatctccgtggaggaggctacccgtttttccctgaacagcaacagcagcgttaccgttcgggacggcgaagccactctggtgattctggctctgcagcccagcagagaggcctgagctgcgcaagaccgggagaccgcctgcaggcggcctcccggcccttttctgccggagtccagagggcggtctcagccgcccagtgccacgtccagcaccatcatcaccaggaaccccatcacaaaaccgcaggtccccgcccggctgtgggcctggggaatcaactcctccaccaccacgtacagcatcgctccggcagcaaaactcagcaaccagggcatcagcgggtccacgccggccgcggccagtgccgccagcacgccgaacaccggctccacggcgccggagagcattcccccacaaaggccctgggacgggaccagccgccctgccgcaggggcagagccacggcggctccctccggaaaattctggatgccgatgcccatggccagggccgccgccccggcaaagccctcccctccggacaccagggcaaaggccagccccaccgccatcccctccgggacgttatgtagggtgatggctgtcatcagcagagtggtctgccgccaagaggcatcctgccaggtccggtcccgccgcagatggggcagcaaggcatccagagcggacaggaagaccacgcccaacagcattccgcccgcggcgggcagccagtccggcagcgccccctctgcggcccggtcgatggccggcagcagcaggctccacacggaggccgccgtcatgactccagcagcaaagcccagcagggtcttttgaaagtggggccggggttccccggcgaaaaaaaacaccatggccgcgcccagagcggtcatcaaaaatgtgaagcccgtacccagggccgcccagccaagagactgcagcatagcaccaacgccttttctctgattcaggcggaacaccgcccgtatgccagtataagcggcaggacttcccggcgtgacagggcttgcatccggggacgatgtgtgatatggtataggcagcaggaaaagctcatataagttcgctgtcatggcgcgaacgtctctacggagccgccgaaggctcttctatgagtgtctgttggaaggggccatcccctgccggcaggcgcttcttttctgtctgaaaaatccggaacggaaacaaaaggagatttgccatgtcactgacgatcatcaagggaactattctgtccgctcccaccctgggacagctggatgccctgccgggcggatatctggtggccgaggacggcctcatccggggtgtgtacgggtctttgcccgagcagtacgccggtgccccggtggaggactggggagacgcgctgatcctccagtcctttgcggatctgcacctccatgcgccccagtaccccatgctggggatgggcatggacctgcccctgctggactggctgaacgcatacgcctttcccacagaggcccggttcgcggacacaggctacgcccgggagatttacagccgcctggcccgggagcttattgcaaacggcaccacgcgggtgtgcatgttctcctctctccacacggacgccacgctgatcctgatggaggaactggagaaggccggcgtcaccggctacgtgggcaaggtgaacatggaccggaacgctgcccccggcctgttggaggagaccacagaggagtccaggcgtgagacgctccgctggctggatgcctgtcaggacttccgcctggtgaagcccatgctgacgccccggttcaccccctcctgtactaatgagctgatggcgtttctgggcaaactggcggcggagcgggatctccccgtccagtcccacctgtcggagaaccaggcagagatggcctgggtgcgccagctccacccgggctgccagcagtactgggagacctatgccaaatacggcctgtggaccagccgcgccgtcatggcccactgcgtctggtccgatgcgcgggagcggcaggccatgcgggacgccggcgtgacagcggtccattgcgccgactccaaccagaacatctgctccggcgtggcgccggtgcgggccatgctgaatgagggcgtgaaggtggccctgggcagcgacattgccggtggggaccacctgcacatgttcgatgtggtggccgcctccatccgggcctccaaggcccggcgggtgctggacaactgggagacggatttcctcacggtgccggagggctggtacctggccacctccgccggtgcggcatacttcgccgagcagccgggctttgccccaggcaatcatctccacgccctggtcctggcggacgatgatcttccccagccccatcccatgacgccccaggagcggctggagcgggcggtgtatctgcgtcagggcggcgccatccgggcggtctggagcgagggacggaaggtattctccgcagagggttgatcaaagagcgggatgctgtgtgtcccgctcttttttgttcccgtcagggaggcctccctggggagtggtatgggccggcacacccctaaaagcaaacgtgcggcgcaccctgaaacggatgcgccgcatctattttgtattgctcacgccccggcaaactgcgccgggtcccgcagggcgtccgccgtttcccggggcacttcagcggtaaacgtcagcagaccgcccagtccttccacgcctacaaagctcccaacgccctccagggtatcggacaggacctccgtggtgacggcgttgctgccctgccgcacctgggtccggaagacctccaggtattcccgctccgcatccgggtcctccccagcgtggagggtagtctcctgccagtagacataagtgtagagagggtctccctccgcattcccgtggtcggcgttctcgccgccggccttgttgatgagggcgtcgatctctgccacggccccgctgtctgtgacggtgtacagctctttaccggcggcgtccagaatctggtagtagtggtccttcactgcctcctcagcggtgtcggccgcagcttgttccccgccgcaggcggtcagcagcagagtcagggaaaggatacaggggattatatgtcttttcatggctgcctcctgtgtttttcagtgggtggggttcgttgagggctctccccgctgccgttcccccggcggtcacggggcatctgggctgcgggtcgatgagggtatcggcccctgcggatgggttggatctccttctgccctcgttcgcccaccgggatgtcagtcaggtatccatttcgcagaaatacagcgtgtcgctgtccgcgtcatacacggccaaggtgacattcagcgaagcccgctccagaaggttttgtccatccccggcgtcactgtggcggtcaatcaggcggtagaagccattggcgatccccggcagcaggggatctccgctgtcatcggtgagataagggcccgcgctgaaaacttcgccgccgtcctctcgggtgacgccataggccagtgcctgggccgtctcgtccaggggaagcggtgtccaggcggcgttcgccgcaatggcgtcggctacctggctgtcaggaaactgcagggcaacgcaggaaatgccgtcgccgtggaagccgccgtgggtgtcagaagaggagatctcctctccggcggacacatcgatgtgcagcgctcgggagatctcctctgccgggtcctcactgccgcaggcggtcagggtaaacagcatcaaggaaatcatgccacatgcaaaaaggaatttcctcatagataacgaaccccttataagattcaaaacagctgcaccacgccgtaggtcagcgtggtgacgatggccccggcaatcaccacgcccaggaagatggcgggcagcgcgtggcgcatccggatgtccagcagggccgccaccagagcccccgtccaggccccagtccccggcagggggatggctaccagaatgatgagtcccggcaggcggtacttccgcaccatccggcccttcaggtgagcccggcgctccagccagtcgatcctggggccgaaaaggcgggtgccccggagccagtcgaagatccggcggatcagcagcaggataaaaggcaccggcaccatattgcccaggatggacaccaggcaggccgcggccggggagagtcccgccgccactcccacaggaatggcgccccggagctccagcaccggcaccatagcggtgccgaaggtcagcaggatcgcttgcatcaggttttcctctacgggcatggcggcctcccttaagatttccggggccgtgggatcactcccacggcccgccggaagcgtatggtccagtttactccagattcaagcgctttttcaaggtaattgtggttacaatatagaaaatcgcaccgtagagcactgtcagcaggagcaaagccaccatcgtgaagtggaccgccgccacgccggtgagctggaaatccagcgtcagcaggaactggtgcaacggcccctcgtccagcaggaccagaacgatggcccccgccatctgcaccacaaactggaacacaaagaagaacgccacggacagggccatcttatggttggcaaagctgtggcccgccgccagagcggcatagaactgcagggagaaactcatgcaggctgccagcatcagcgccagaagctccagcgcgaaaacggtgccgttgacggcgtagtaggcggtcatctgctggaacagcttggggaaaacactcgccaaatccgtcaagaagctcacgttgaaggccgccacaaaaacagacaggaacaccaccacgccggtggcgatgaaccacacggcggagacgatcagcttgctccacacatgctggtgaaccgaggcgggcagagtgaacatgatgtagccctcgtccccagcagatttttgtagaaccgctggagcatcagaatgaacgccacaatgaacacggcggtaatggccaccacataggccatgaccaccaaagcggccagcatattcagcacaaagttgcctgagtccatcagcctggcggagaaattgaagcccagggccaccgccagcagaaccaggtacaaaggccccatgatgcgggccgtggcacggaattcgtgcttcaagagtttcgtcagcatttgaacacctcccggaacagggcgtccacgctcatgcccttctcctcccggatctcatccacagaggactggagcaccacctggccctgattgatgaaaatgacctcgtccagaaccttttccacatcggcgatcaggtgggtggagataatcactgccgcctcgggattgtaattgccgatgatggtggagaggatgtagtcccgggtggcggggtccacgccgccgatgggctcatccagcagatacagctttgccgcccggctcatcaccatgatgagctgcaccttctcccgggttcccttagacatctgcttgatccgctgggtcaggcggatgttcagatgggtgagcatctcctccgccgccttccgattgaagtcccggtagaagtcgccatagaaatccagcagctgcttcacggacatccaagtggggatgcaggtccgctccggcaggtagctgacgctggcgtggctctcctttccaggggccatatcgcataccagcacctctccctcgctgggggtcagcaggccgttggccagcttgatgagggtggtcttgccgctgccgttggggcccagcaatcccacgatccggcccggttccaccgccaggctcacatggttcagcgccggcgcgttgccgtagtgcttgctcagatctttacattccagaactgccattgtcttctcctcccttggtctcctcctgccgcagcagcgtcaggatctcctcccggccatagcccaggtgggtcatggcctccaggaacgcctgaatgtggcgctccgccaaacttctctttgcagatgcaatcatggcctgatcctccgtcacaaatctacccgtggttcgctggctgtataccagtccgtcccgctccagctccgtcagggcccgctgcatggtgttgggattcaccccggcctccgtagccaggtcccgcacggaaggcagccgctcccccggcgggaacgcgccggagacaatgcccaccttgatctgcgcgatcagctgggaatagatcggcgcgtcattggaaaactgccacttcacagaagcacctcccatttgtgttgttgtactaagcaagtaatacaatagcacattctccagatttgtcaagtggattcgaaaaaaattttggagaggcaaaagcgccgcagcggcttatcgctgcggcgcaagggattcatcggttattcgattttgcggagggaggttctctgatcataccggcagcccaggatgaggatggcgaagcccaaaatggtcaccagaagacagggcaggtcgtcccaaaaagtcacctccacaaattcccacatattctccggcccatactccgccagatacaccagcaacgcagtggaaatactccagaccggccccgtctgcaaaaaccgcagaggcgcgggaagggggagccgcatgttcagcagacccatcagcaccaggagccagcccagatgataccaacgaagccgccctgccaattggcggccccggaataccagaatcacagacacgagaatcagcagcacatggggaatcattgtgggaatatacaccatctgcacgtatttcacccaggcaaaattctcgaggtcctgcgcctgctggtatgtattggccgcaagaacagccaggtcaaccaggttccagacaccccaggccgccagaacccaggccagcagatagcccctgttccggtaccattgcttgacccggacccacaggcccgccgcaggagccgtggtattggccgtctccggctcctctagttcttccagcaataagtaatccgtggacacgccgaactggcggctgatgcggacgagcttctccacctccggcatagcctcgttccgctcccacttgctcaccgcctggcggctcacatccagcagcttggcaagctggtcctggctcaatcccgcccgggtccggagcttttgcagcttctctccaaaggtcatggcgcttccctcccctgccgttttcacacgttcaggataccagacgataccgggacatgccagcaaccaaacctggaatttccgctaccacaggtagcggagcggtgtttccggcgctcaggcgtacattttgtccaggcgggacacgatgtccgccagagtgtcgtggtccgcatctgccacgatggtggccccgcaggcccggacagcgggtacgcagttggcgggggcaaatccctccgccgcccaggtcagcatggacaggtcgttggcctcgtccccggcgcagtagacgtgctggcgggagatgcccagccgctccgccagccgggccaccatgccacccttggtggcgcctctggcggtgacctccagcagtgtccggtcagagaagaagatctcatactcccccgcccagggctgggactgcagaaacgccttgacctcctccaaaacggcgtggtcctcctcaaacatgatctttcccagcggcaggggcacatccagcagggagggcttttccaccacgctcacatgagtgacgtgctcatgctggcgggtatagagattgggccggacggcgtggatcacgttgtcgatgtggtatgcctccaccgccagcgtggggaatcggtccagagtctcctgtccccgccggcgggtgctctcgtccagcagaatggtctccagatactcccccttctgaaaatcatacagggccgcgccgttgcacacaatgcccggcgcgttcatgggcacctgatccgcgaatttgatgaaggccgccagcgcccggccggtggcgatggcaaatctcccgccgccggccatgaaatactccagcgcctcccagttccggcgggacacctccggcacctcggcgcccgtgcgccgggccgtctccgtattcagcagggtattgtcaaaatcgctggccagcagtacaccgtcaaattttcccataaaaactcctccatcctatctctctgaaaaggcagatccgctccatctgcctgctctcccggcatttcaaaagaccgccgcccgaaaaaggggcggcggtccagccggattcactcactcttgggggcggaaccgccgccctcgccgccgtttttgttccggcggcgcccccccggtggtggggcctgcggcggcgcttggcctcgccttcaccgtccggggccgccgccctgttctccccaggtctggcttctgtcggcttgggctgcgcaggcctgctctcctgtttgggggacggggccgcccttccttcttctccggccccctggcctcggccttgggctgctcgaccccctctccgcttttggctccccctctccggcggccgccccgatgccggcggcgtggcttgccgtcgccgctgccgggtgcgccgatcttctcccgcatgggcgcctcttccagctgcgtgtccatatagaagggcggcatcagggccggggcctcctcccggaactcctccgcctccttcggctccacatagcgggcggggcgctccggaatggcgatgccctcccggctgcccttgccgttgcgcagaacgcacacctcacagttgtgatagcacttcaaaggctccggcgcactgtccaggctgaccttcacggtctcccgcagcaggtccacgctcttcacattgccggggccgtccggcgtctgaacaaaggattctgccttgggcatccgcttggctgcgtcctcatagacgttctgctcgtatttcaggcagcacatcagccgcccgcaggtgccggagattttggtgggattcaggctaagattctgggtcttggccattttgatggacacgggcaggaacccgtccagaaactgggagcagcagaagggtctgccgcagatccccagaccgccgatcatcttggcctcgtcccggacgccgatctgccgcagctcgatccgggcccggaacaccccggccagatcccgcaccaactcccggaagtccacccggccgtcggcggtaaagtagaagacgatcttgttgccgtcaaagctggcggacacgttcaccagcttcatctccagcccgtgggcggcgatcttcttctcacagatgtcaaaggcctcgctctcccgcttcttgttctgctccacggtgcggcggtcgctgtccgtggccatccgcagcatagggctcaggggcttgacaatggcggagtcctccacctcgtggttcccctccgtgcaggtggcgaattccgggccctgggcggtctccacgatcacctggtctcccatcttcacctggttgccgtttggattgaaatagtaatttttacagccgcctcgaaagcggacgctgataacttctgtcaaaggatgccctccaattccaccgcgatggcgcccagcacatggccggttcccacgttgtacgtgcactccccgcgatacttctgtaacagctctattgtgcgcatgatttgggattttgtcaagtttttcgcgagaattggggcgatttcccggcagctttcctccggttcctgtccatattgcagcagcagcgccgccgcgcacagggcccggctccgctccagcagggcggacaggtcctcccgggtgatgcgctttttctccagccgcaccgccagctccgtcacctttccccgcttccgggcggccaggcagcggcacagggcctctgccgcctggacctcttcaccgccgccttccgcagccgggtgcagcttcagctccacgcaccgggagcgcagggtctggagcaccacagcggcattttccgcacagaagagaaaggccgcatagggcggcccctcctccaccaccttcagcaacacgttctggtcctgttccgtcagcagggcgcagtccggaaacacatagaccttccgccgcccctcgttggggcggatgtaggcgtctgcccggatggcgcgcaccacgtccacggcgatgttcttatggtctgggtcccggacggtgatcacgtccggatggatgcccgccagcaccttccggcaggcggggcagacgccgcaggggcggctctcctcccccgtgcactccagggcggcggcggcaaagcaggcggcggacatccggtcgccgctgccggtgagcagcagggcgtgggacagggtgccgcgagtggcggcctcccggatgcggatggcggctggctcctccggccgcaggccgaacagggacatggcgtactctccttttcccgctgtgagcacgggctgatctgcagattttccggcggcgccgggtgtttggggcgcccggcggccttccggcgggcacactggagccattgtaccacatggccccgaaaaaggaaagaacgtaaatattttctttgttgcgcaactgttaattgtgtggattgcacaaacatttgtgaaaatactccagctatccccaaatttcttagcatttttatgtattgttttccgaaaaaattcccaatataatgttatcgttatcaaaatgggctaatcgtttaaccgcagattggagtccacccgactttcgactgcggcaggaaagagaggtttggactacatgagcaaaaaatatgtctatttgttcagcgagggcaacgccaacatgcgggagctgcttggcggcaagggtgccaatctggccgaaatgaccaacattggcctgccggtgccccagggcttcaccatcaccaccgaggcctgcacccagtactatgaggacggccagaagatcaacgacgggatccaggcggagatcatggagtatatcaccaagctggagggcatcaccggcaagaagttcggcgatctggagaaccccctgctggtctccgtgcgttccggcgcccgggcctccatgcccggcatgatggacaccatcctgaatctgggtctgaacgaggacgtggtggacgtgctggccaagaagtccggcaacccccgctgggcctgggactgctaccgccgcttcatccagatgtactccgacgtggtgatggaagtgggcaagaagtactttgagcagctcatcgaccagatgaaggaggcccgcggcgtcacccaggacgtggagctgactgccgacgacctgaaggagctggccggccagttcaaggccgagtacaagtccaagatcggcgcagacttccccaccgaccccaaggagcagctgatgggcgccatcaaggccgtgttccgctcctgggacaacccccgcgccaacgtgtaccgccgggacaacgacatcccctactcctggggcaccgccgtcaacgtccagtccatggccttcggcaacatgggcgacgactgcggcaccggcgtggccttcacccgcaaccccgccaccggcgagaagaagctgttcggtgagttcctgaccaatgcccagggcgaggacgtggtggccggcatccggactcccatgcccatcagcgaaatgagcgaaaagttccccgaggccttcgcccagtttgagaaggtctgcaagattctagaggatcactatcacgatatgcaggatatggagttcaccgtggagaacggcaagctctacatgctgcagacccgcaacggcaagcgcacccctgccgctgcgctcaagatcgcctgcgacctggtggacgaggggatgatcgacgaaaagcaggccgtggccatgatcgatccccgcaccctggacaccctgctgcatccccagtttgacggcgaggtgctgaagaagacccccgtgatcggcagcgccctggccgcctctcccggcgccgcctgcggcaaggtcgtcttctccgctgaggacgccaaggcctgggccgagcgcggcgagaaggtggtcctggtccggctggagacctctcctgaggatatcgagggcatgaaagctgctcagggcatcctgactgtgcggggcggcatgacctcccacgcggccgtggtggcccgcggcatgggcaagtgctgcgtctccggctgcggcgccatcaagatggacgaggagaataagcagtttgagctctccggcaagaccttccacgaaggcgactggctgtccatcgacggttccaccggcaagatctacgacggcgccatccccacggtggacgcctctatcggcggcgagttcggccgggtcatgggctgggccgaccagtaccgccgcctgaaggtccgcaccaatgcggacaccccccacgacgccgcccaggcccggaagttcggcgctgagggcatcggcctgtgccggaccgagcacatgttctttgacgcagaccgcattcccgccatccgccgaatgatctgctccgacaccgtggagcagcgtgaggccgctctggctgttctggagcctatgcagcagtccgacttcgagggcatctatgaggctatggagggcctgcctgtcaccatccgtttcctggatcccccgctgcacgagttcgtgcccactgaggaggccgacatcgagctgctggccaaggacatgggcaagagcgttgcggagatcaaggccatcatcgccggcctgcacgagttcaaccccatgatgggtcaccggggctgccgtctggcggtcacctatccggagatcgccgccatgcagacccgcgccgtcatcaaggctgcgctgaacgtccaggccaagcatcccgagtggaccatggtgcctgagatcatgatccccctggtgggcgaggtcaaggagctggcatacgtgaagaaggtcgtggtggagaccgccgatgccatcatcaaggaggccggctccaacatgaagtacctggtgggcaccatgatcgagatcccccgggccgcgctgaccgccgatgagatcgccaagcaggcggacttcttctccttcggcaccaacgacctgactcagatgaccttcggcttcagccgtgatgacgcgggcaagttcctggacgcctattacgacaagaagatctacgagaacgatcccttcgccaagctggaccagaccggcgtgggcaagctggtggatatggcctgcaagatgggccgcgccaccaaccccgagctgcatctgggcgtgtgcggcgagcacggcggcgacccctccagtgtggagttcttccaccggacgggcctggattatgtgtcctgctctcccttccgggtgcccatcgcccggctggctgcggcacaggctgccatcaaggacgagaagtaatcttctctctcataaaaaaccggaccgcccaaagagggcggtccggtttctttgtatcgatgcataagtcacttcgctgtgggcatgaagggccgcagaacccctgccacctgagagatcggcatggtctggagatagacatggcccggtccggtgataatggtgttgaagatcccctcaccgccgaacaccatgttcttgagccccgggaccgcctggatatccatggagcaggtggcatccatggccgccagatatccggtatccaccaccagggactcaccgggatccaggtcgtattccacgatatgcccgtcgaactcggtgaaggcaatcccccggccggagagcttctgcatgatgaagccctcgccgccgaagaagccggagcccagcttcttctggaaaaagacggacagctggacgcccgcctcgctggccaggaagccgctcttctgcaccaccagctcccggcccggaccgatgtcaaaggcccggatgctgcccgggaaactggaggcaaaggcgatcagtccttggccgccctgggcggtgtagcggttctggaaaatggagtcgccggagagcatccgcccaaacgccttccccagaccgccgttggtgctggtctccatcttcatgttgggggtcatccagctcatgctcccccgctcggtgagcatggtctcgccggcctccagctggcagatcaccaccggcagcggtgctccctcgatctgatattccatggtgtgctcctttctcttctcggcccggggccggttttctccattctaccggggccgctgcatcgtgtcaatccaaaccgggcggctttcctggtccctacagaaattttacagccccggcatctaaacggatgccggggctgtgctgcgctcagtactccactacgccggtgtagaccagcttggcatcgccggtgagggtgacggcttcgtcggtgtaatgcaccaccaggtcgccgccctggacccggaccgtgatgtcccgtcccttttcacagaggccgttggccaccgccgccaccaccgcggcacaggcgccggtgccgcaggccagcgtctcaccgctgccccgctcccagacccgcatcttgatggtgctgggatttaccacccggataaactccgtgttgatccggtccggaaaataaggcgcatgttcaaactgcggcccgatccgggccacatccacgccgtccacccgggaacagaacaccacgcagtggggattgcccatgtccacgcaggtgatctcccagggctgcccggcaatctccaccggatagttcaccacctgccgcttcgggatattcagccggagggccgtggtgtccagggtcgcgtagcccatgtccacgcaggcagaggtcaccctgccgtcggtggtgtagacccggacggtcttggtgcccttgtccgtctccagggtcatttcctccttgcggacgataccgttgtcatagaggtacttcgccatacaccgcagggcgttgccggccatggagccctcagacccgtcggcgttgaacatccgcatcttggcatccgccttccgggatccctccatgaggatgatgccgtcggcgccgatgccgtagtgccggtcgcagagggtgacgcacagggactccgggcaggtgatctccccgctgaaattctccaggaagatgtagtcgttgccgcaggtctgcattttggcgaagggcagcttctgccgctccgtccgcagatggcagatatcgacgagctccgtgttctcctggttgtagcggctggccaggatgtccgtcagggcaccggccgtatccagcgaggtcaggcagggaatgcccagctggacgcaccggtggttcaggtggatgaagtcccggatatactccggctccgtagagccggtgaggatcacgtagtcgatcctgccggactccagcagctggaagacccggttgtcccggcccagcttgcccaccacctccacgtccgtgcccaggcgggagatctcccgtgcggtgccgtcggtggcgtagaggcggaagcccatttcatccagcttccgggcgatgttgacaatctccggctgatcccggcggttcacggagatcaatacccccgcgtgtccgctcttctccaccttgtacccggcggagaccaggcccttgaacagcgcctcctgcatattggcgcccaggcccagcacctcgccggtagatttcatctccggggacagggcggcgttggcgtcggtaatcttctcgaaggagaacaccggcaccttcaccgccacgtagggcggacgtttgtacaggcctgtgccatagcccagggccttcaggggctggcccaccatgacccgggtggccaggtccaccatgggtacgccggtgaccttggagatatagggcaccgtccggctggcccgggggttcacctcaatgacgtacagctctccctgatagatcaggtactggatgttgataagcccccgggtcttgagggacagggccagcttttcggagcagtccacgatggtctggagcatcttgtccccgatggaaaagggcgggtacacggcgatggagtcgccggagtggacgccggtacgttcgatgtgctgcatgacgccggggatcagtacatcggtgccgtcagagatgacgtccacctccagctccttgcccatcaggtactggtccaccagcaccgggttctcaatcttgccggagaggatgatctccatgtagcggcggacttcctcatcgttgtgggcgatgaccatgttttggccgccgatgacgtagctgggccgcagcagaacaggataccccaattcattcgctgcctccagcgcctcattcatacccagcacgccccggccggcggcccgcttgatggaaaaccgctccagcagcgcgtcgaaccgctcccgatcctccgccatgtcgatggactcggcgctggtgcccagaatggggatgccgcggctgtccaggaatttcgtcagcttgatggccgtctggccgccgaaggccaccaccacgcccaccggcttctccacggcgatgatgtgcatgacgtcctccgggtacagcggctcaaaatacaggcggtcggcagtgtcgtagtccgtggagacagtctccgggttgttattgacaatcaccacgtcgtagcccagctccttcagcgtccagacacagtggacagaggagtaatcaaactcgatgccctggccgatgcggatggggccggagcccagcaccatgatgaccggcttgccgctgcgggggaaggcccgggactcgcagaaccggtcataggtggagtagaaatagggcgtctccgcgtcaaactccgcgccgcaggtgtccaccatcttgtacaccgcatcccggtgctccggcagttctccgccgccggaaagcctgcggagagcctcatcgggatagcccagccgcttgccctcccggtactgcgcctccgacaggccgtctgcaatggaagcctcgaacgccgccagcttccgcagcttgcagaggaaccaggggtcgattctggtgatgtcgtggatctcctctacggtgacgccggatttcagcgcctcgaacaccgtgaagagcctgtgatcgtccactcggcggagccgctcccggatgggggcgtcgtccccgtggtccggtttccggttcagggtgtccatgccgatctccgcgccccggacagccttgagcaaggccatctcgaagctgggggcgatggccatcacctcgcctgtggccttcatctgcgtgcccagggcccggctggcatcggcgaacttgtcgaagggccacttgggcatcttcaccacgatatagtccagggtgggctcgaagcaggcacaggtcttgcccgtgatgtcgtttttaatctcgtccagggtgtagcccagagcgatcttggtggtgatcttggcgatggggtagccggtggccttggaggccagggccgaggaccggctgacccggggattcacttcgatgaccgcgtactcaaagctctccgggttcaatgccagctgcacgttgcagccacccacgatccccaggtgggtgatgatgtccagagacgccttgcggagcatctggaactccttgtccgccagggtctgggtgggggccaccacgatggagtcgccggtatggacacccaccgggtccaggttctccatggagcagacggcgatcacgttgcccacgctgtcccgcatggtctcgaactcgatctccttccagccgaagatggccttctccaccaaaatctgcgtgatgggcgaggcgtccaggccggtgcccgcgatgatcttcagctcgtcgggatccttggccgcgccgccgcccgcgccgcccagggtaaaggcgggccgcacgatgacggggtagccgatcttctccgccaccgccagggcctggtccacggtctccgcgatgtcggaggcaatcaccggctggccgatctccgccatggcctccttgaagagctcccggtcctccgcccgggagatggccgctgcgtcggtccccagaaggcggacgccctgggcctggagaaagccctccttgtccagctgcatggccagggtcaggccggtctggccgcccaggcccgccaggatggaatcggggcgttccttcttgatgatgcgcttgacggtctccacggtcaggggctccaggtagatctcatccgccatggcctgatccgtcataatggtggcggggttggagttgcagaggaccacgttgatgccggcatccttcagcacccggcaggcctgggcgccggcgtagtcgaactccgccgcctggccgatgacgatggggccggagccgatgaccagcactttctgaatgctcttatccagcggcattaccggtcaccccctttcatcagagctacaaattggtcgaacaggaacgatgtgtccttgggcccggtgcaggcctctggatggaactggaccgtgaatgcccgcaggtccggatagtcgatgccctcgcaggtgccgtcgttggcgttgatgaagcggaccttccccaccggcaggctggtaccgtccacggcgtagccatgattctggctggtgatgtaggtgcggacgccgtccaggtcccggacgggctgattgaccccccggtggccgtatttcagcttgtaggtgccgccccccaccgccagggccgtcagctggtggcccaggcagataccgaacaggggcaccttgcccaggagctttttgatctgctcaatctgatagacgttctctgccggatccccggggccgttggagagcatgacgccgtcaggcttggccgccagcacctcctctgcactggtctgcgcaggcaggacagtgacggtgcagccgcgcttttgcagctcccggacgatgttgcgcttggcgccgtagtccagcaggctgacccggaaccgctcctctccctccgccgggtgggcggatgctgctctacaggtcaccgcctccaccacgccggtgacggcataggtcttcaccgccgtcagatccgccggaacctcatcacagatcgcggcgttcatgacgccgtgctcccggatgatccgggtcagctcccgggtgtccacaccccagagccccggcacgccccggtcccgcaaaaaagcgtccaggtctccctggcagcggaaattggacggctcctcgcaccactcccgcaccacgtagccccggacgcaacacgcgccttcaaaatcctccggaatgatcccataattgccgatcagaggataggtctgcatcacgatctgtccagcatagctgggatccgtcagtgtctccagatagccgcacatgccggtggtgaacaccagctcgcccacggcgtccgccggccccccgaaccggaagccctcaaacacctggccatcctgtaataccagatatcccttcttcatgtcgtcctccctctccggcgcatcgaccggaaaatccctattagatgttattatgcgttttttttctgaagcagtcaatccccccgtgcagtgcggcacggtagacttttccagggatgaaggtattactttttgtgcattttcgcaaaggtcgatctatttcccgccgcactgcctctcttgcaaagcagtaaccaatgggctatgatgcaggaaaagcggctcatctgcacaggcggaagaactgctccggcaaaggagtgcgcctatgatctgtttgcatgcattccggatgcccgcccgggaggacgaagaggcattcttctccgatccccggaaccagcggatctgctataccgccaaagagccctttcatgtattccgctgctgccatctgccgcagcacccacctccccattccccaagagggccggatcatcaccagcgacgatgtcttcggccacctgccggacatccgctgcatcaacggcggcatcgacgccgccccggccccgcctctggacggcgctggacaatgtgcgggtctgccgggcgttctttcggaagcgggaggcagacttccgctccacccgaaaacgcgccgcagtcgggccgcaaggtattttggactgccggacaaagaaatttcttctggcgccgttgtcatgcggtggcccgccatttataataaaggcagcaaaatcagggaggaggcgcatcctgtggcaaagcatctggacaagtttacccagcccttccgggacagccccatccccttcgccctggcggagatactgaccaacggcagcggggagatggtggatctggtgtgccgctttttgaatcctgccgcggcggcgcttctggggctctccccggaggaggtgcagggccgccgcctgtcccagctcgggtcagagcgggcgctggagcagctggcgcccatgcaggccgtagctttttccggctcctccgcctccttcccctatgtgaccgccgggggccaaaccctcaccgttacctgctatcaggtgatgtacggcacggtggcctgcctgctggatccccggtcgggggccggagcccagagcggcgcgttgccggagctcctgcccggcgcggatctggagctgaaccgggagggactgcggtgccttgcctgcagccggcagctgtgccagctgacccagtggtcccggcgggcgctgctggaccggggcggcagggccttttccgctctggtggctccggcggactggccggcgctgctccagaaactgctggacgcggcgcgggagaaacggggcgtggatcacgacttccgcctgctgcggcgggacggtggggcagtctgggtgaatctccgggcggaaatcctgtcgacccgccagggggccacggtcttccgcggcgtctttctggatatcgaccgcctccggcgggaggggcaggacctgcaggcggccctttcccggcgggagacggctctgcgggatgcggagacgctgctggaccggatgccggtaggtctctgcctgctgcgccgccgacctgacggtggcgtggagctgctgcgggccaatcaggttctctcccggctgctgggcctctcgcccgcagctctggcccgccgtctggcggaagacccgggcagcggcctgccgacgggcgagcgggaggaactgctggccgcagctgttcggtcccgggagtgcggcctgcccctgcgccgggcctgtcgggtctgcctgggcggcgggcgggaactctgcctctctctccacatgtcctgggtggaacagccggacggctcctggctggcatacatcgcctgtgccgatatctcccaagaggccgcggcccaggccgagcatcagatccgctcccggatgtacgacctgctgttagagcacacctccctcctgacactggactatgaccccgcccgggacctggcccagatccagcggcacagcaccagcggccgcaggacctcccgcaccgtctccggctatctgaagagcctgctcaccgcgtcctacctccacccggaggaccggcggcggctggcaggcgcggtccgtcgggccatcacgcatcccgggacggtctcctgcacctatcgggcggattatgaggacaccggctggcgacgctatcaggtgtcgtggatgagcctattcgatgaagccggaaatgtgtaccgtctgctgggcaaagcggaagatgtgactggccgccgggcggctgcggaacacttccggcagttggccgcccggcaccgccggcaggccagggcctgtctggcctccgcccggctggatctgaccgccggacagacattggacgccaaggccgcgtcccggcacctgctgcgcacgctgttcgaccgtaccgcaggcgcctgcctccagcagatggcctctgccctgccggaggcagaggagcgggcgcggttccaggctctcttctctccggatgctctgtcggatgcctttgcagaaggcgtgttccaattctccatggaccactggatctctaccggaaagggcggcccgtcctgggtccggatagaagcagagatggcggaaaacccggacacgctgcatctggaagtctttttccagctgtgggaccggagcttccgcaggctgcaaagcactctgttggataccctgaccaggcaggattacgagctggtcctgacagcggacgcccgctccggtgcctgccgtgcctatggaccgtccgcaggccgtctgccggagaacgccacctgccggtccctggccgcctggtatttccagcagctgccgccctcccaccagcggaccgccctgcggaaagccctctccctggaggctgtcttgtcccagctggaggcagttccctctgtggagctggtcctcccggccccggaaggagcgccttaccatctgcggtgttccccgctggaggggatgcccggcgtgctgctggtgacttgccgccgccttccggccggcacgccgtcccccgccccataaacgcagaagacccgccgcaggctatcgcccgcggcgggtcttccatgcacgacgcagcttgagcactgccagaaatacctccgtcgggatctgcacacttcccagggagtacatcttctctttgccataccccacaggacctccggttctacggggacccctcatccaatcagagcgggcaggctgagcctgcccgctccaagggtttccttccgaaaccgcttgacgccgctcccgcggcgccgggccgctggcccgggaaggagggcttactcgtccagcttgagcactgcgagaaatgcctccgtcgggatctgcacgcttcccagggagcgcatctttttcttgccctccttctgcttttccagcagcttcttcttgcggctgatgtcgccgccgtagcacttggccagcacatccttccgcatggccttgacggtctcccgggcgatgacccggccgccaatggccgcctggaccggcacctcgaacagctgccgggggatgttctccttcagcttctcgcacagccggcgggcccggggatacgccttgtctctgtgggcgatgaagctcagggcatccaccgtatcgccgttgagtttcatgtccaccttcaccagctcgctggaccggtagccggagagctcataatccagagaggcgtagcccttggtgttggccttcagcgcatcgaagaagtcgtagatgatctcgttcagcggcatctggtagtggagctccaccagattggtgtccaggtactgcatgtccttgaactccccccgccggtcctggcacatgggcatgatgttgcccacgaactcgttgggagcgatgatgttcaccttgacatagggctcctccgcgtgctcgatcaccgccgggtccgggtagttgtggggattgtccaccgtgaccatggtaccgtcggtcttgtacacgtggtagatgacggagggcagggtggtcaccagatccaggtcgaactcccgctccagccgctcctggatcacctccatgtggagcatgcccaaaaagccgcaccggaagccgaagcccagggctacggagctctccggctcaaagctcaacgaggcgtcgttcagctggagcttttccagcgcgtcccgcaagtccggatacttggagccgtcctccgtgtagataccgcagtagaccatgggctgcacgggccggtagccgggcagggcctcggccgtggggctggcggcatctgtgacggtgtcgcccacacgggtgtccttcacgttcttgatggaggcggtgaagtagcccacctcgccggcccggaggctgtcgcaggactccatgcccaggggcagcagatggccgcattcgatgacctgataagtggctcccgaggccatcatcttcacctgctggcccgtgcggagggtcccctccatgatgcggaagtagacgatgacgccccgatacgagtcatactgactgtcgaagatcagcgccttcagaggcgcattcgggtcccccttgggggcggcacgttctttacgatatcctccagcaccgcctcgatgttggtgcccatcttagcggagatttccggcgcgtccatggccggcaggccgatgatgtcctccacctcctgcttggccttggcggggtccgccgccggcaggtcgatcttgttgaacacaggcagaatctccaggtcgtgctccatggccagatatgtgttggccagagtctgggcctccacgccctgggtggagtccaccaccagcacggcgccctcgcaggcggccagagagcgggacacctcgtagttgaagtccacgtggcccggggtgtcgatcagattcagttcatagtcctccccgtcctgggcatggtaggtcagccgcacggcccgggccttgatggtgatgccccgctcccgctccaggtccatgttgtctagcagctggctctccatctcccgggcggagacggcgttgcacttctccagcagccggtccgccagcgtggacttgccgtggtcgatatgggcaatgatgctgaaatttcggatgttgctctgttttgtcatattcggatattcctccatcggccggtccacgcaaggcccgcatcaagggcccggcgcgcatcgccgttctttcaatcggaatgggggccccataaaatccgagattctatggggtggtgaggcgcaagggagcggatgcggccttcgccgccggacggctctgctccgcctgggagtctcctgtcacagggttcctccccgggccgccgctttatggggccgcggcatgttctgcgttccactgaatccagaatcgctcgtcccagaactggtcatagtcatagtgtaccacaaattcccgccagttggcgagggtctcctccagattttcctctgtcaggcggccctcctccctttgaagcatggcgagaatctcccggcagacgccgccggagtggtggatatagtcgcagtagttgtccagattcgtgacgatctccgggtccatgagatagccgtagaacttcacattgtcatactgcagcagcgtctgccctgcctggcggatggccgcaaacaccgcctccgtcctcccctcccgaatgaccttgtcccagaagaggatgctgtacgggggcaggaagaaatcgaattccgtgtccggatgctctgtgacccaccgttccgccaccgccagattggcggccacatcgtcccgataggcatctgcgggcagctcctccgccgcaatctccggccggtcatagttctccagggcggagatatggttccaccactcattccggtcccaggtgaatccctcgtcgatggtgtcgccctctccccagtggttggagagcagggtgtaggcgctgtaatacagcgtatccttgttcagcagatattggatgtcatccagcggattggcgttgtagagatagtccggcatggccgcagtcacaccgctctcatcccggatcagggtgttcacatccaggccgaagatcacccgctccggctcctgggtccgaaagaggacgttcatcacctggtcgaactcgctgtaatacccgtccgggatggtgagccgcaccgcggaggtgccgaaggtctcctgaatccagctggagcggtagttggccgccatggaggtgcccaccagcacggtgtccgcctccacattcttcgccaggcccgccatctggtaccgctcattgaacagcaccggctgccacttgtccggcacccgataatacaggcagggatccaccacgtacacaacggctccgcagaccgccagcagcaccagaatacacgccagaaggccgcagacccagcgtcgatatgcttgcttcatacggccctcctcagaagttggaatagatgaaggtggtgacgccggtaaaggacagcacacaccaaagcgtcagcactgtgagggccgcgccccgccagagcgtaggccggaagtcctccatccgacggatggtgttccggggccagaggacggcaaccatccccgccccatacagcagcaccacccgcaggatgtttttccagggcgtgaaggcgggaatcagcatctgcaccgcgctggtctcctcggcgaaaaggccctccagcagccaggccgccggttttgcaaagccgccggtgacggcccggcccagcagctccagggccccggtacagtccggtgcccggaagaacacccaggcgatgttgacaaagagaaaggtcagcccccaccggaggacaaagggcagccggtcccggcccctgccccaaacccgttccaccacctgggccaggccgtggagggcgccccacaccaggaaggtccacccggccccgtgccagaagccgctgaccaggaagacgatgagaatattgcaatacgtccggatcgcgccccggcggctgccgcccagggggaaatacaggcactcccgcaggaaggtggtgagcgtgatgtgccaccgcttccagaattccgtcacagaggcgctgcgatacggggagtcaaagttcatcggcaggcggagcccgaagagccgggccacaccggctgcgatgtcgcagtagccggagaagtcaaagtacagctggagcgtataccccaaaatcaccagccaggccgccggagcgctgagctcttccagatgtacccagccgttgttcaccacagtgccgaaggcgtccgccagcagcacctttttgatggtgccacaacagatggcgtagatacccgccgcggcgtcggaccagtccggatggaggaatcccttttcccgcagctgggggaaaaagattccgggccgcaggatggggccggaggtaacggtggggaaaaacagcccgtagagcagaagggaatcccccggcgcggggacatattccccggtatagacctccttcagcaaccacagctgctggaaggtgaaaaagctcagccccagcggagcccagcccacctccaccgcgccgccggtgaggaactccgtatacttgaatcccaccagtatggcgatgtgatagacgcaggcaagaaccattgtccggcggcggccgccggaccgggccatccggcggatagcccatgctgtcacgcagatgcctgccagcaggcaggcaatgcccccagcaccaccgtccatcctccggggcccagaaggcagaataccgcggaggccgccgccagcatcgccgcacccgctcggggctgcgccgccccgctgtcaggcacaccgccagcgctgcggccagaaagccgaaaaaggccagagactgaaagctcatctggtcttctccgtcaggccgctgagacgggcatccgcggtgctcagcacctgggtcaggctctgacaccgtccggggtatgcggcggtcagggcctcgttggacaggtccgggaacgccgcctttttggccgccagggaccgcaggctccgggtgtactggatctccgagagcttcatgtccgcctccgctgtgcccatggtgcaggcggccgggtccagagagaagtacgcctcgttggcgccggcggtgcggtacagatggcggtacagctggtacaccgcgctgcccagatatccggcagcggcgttgatggacgccttgtcgttcagcttgcccagcaggccgaacagcacccccacagcgccggagagcagcttgctctggagcgtggccagcacgctgccctggaggatgttgcccggttccgcagcgttcaggatctcctgctccgtcagcatgttcccctcccgggacagggtcctgcccaggatgaagtccgcggagacgtggtagtaatcacaggccttcaccacaaaggccaggcccggttcccgaatgccgttttcatagtggctcaacagggcctgggagattcccagatcccctgcggcagttcgctgggagacgccccgctcctgccgcagcagggacagggtccgtgaaaattcagttgtggaagccatcgttctctctccttcagagttaaatacataacgtatagcttaacaaatacgatacggattgtaaagaaaaatcccacggattcagacatttttcgggggaaggcgctgcggcgccttcccccgctgtttccttgccgtccagctcagaacaggcccacctgccccagcagcacgtctcccccgatgctgcgcacctggcgggcattctcctcccacaagcggtccgtcaccgccattttgcggatgatgtcctgcaccgtggcctccagcgcagacccggcccggtagtccgcctggaagatataatccacccggccctttgccagcaggtcctccacaccggcgcggttgctggcctggtacacggcgatggcctggccgccgtaggcccgcatcatcttcatgcagggcacgtcggaaaggccgtcccccatgtagatcatactggtgaagggcacccgcttgctgtcgtcaggcatggaggcgtttagatcccggtcgttggacacgtccagcacgcccttgttgatccggtagacgaactgggtcttggcggtgaagttcaccgccagcttgggccacacgggcacaccgctctcatcgtagtaaaactcgctggcatagatctccttgaattccccgctgatggacgagccttcaatgatctcccgcaggccggaagagatgatgtagtgctccacctggacaccctggccggcgccgaagtcgttgatccgccggaaccagtcctccacaccggggaacagcacgatgctccgccccttctccaccaggtccgtccgggtgaaaggtcggttccgccgcgccgcctcccgcagcatggtgtacatataggccaggataccgtccatccggttcctgcggccgaagccgttggcctccgcccagaactctgcgggggtcatccccagggaggggatgaaggcgtagtcctgcatatcggtggtgcagagggtcttgtcaaagtcgtacagaaaggccacgatgggctgttgcttcatggctgactcctccaatcaaaagacgttgagcgccgggaccgggaaagaaaaaagcggctcctgcgagccgctttgatcgttcagtcatcgccgccggagtaattgcggccgaacttcagatcgttgagattgatgcggcgggtaggctcatccacaggatcagccgcaaaggggtccccctccggatagtcatcctccgccgccggagacgcctcttccgcttccgccggggccgcttcctcctccacgctctgctcgctgaaagcggccagcaccttttcctcgatctgctggacggcctcctccggctcctgctgggaaatcggctccgccgcctccaccggcagctcgggcagctgctccaggaatttcagctccttctcacagatctccctgctggcggcaatgaactgggccagatcccgctggccctggtgcagccgctcctcggcggcctccacctcctggcgcagctggccgatcttctcccgggcgctggtctccgcttgggccaggatctcgtcccgcttggcctctgcctcgtggacgatggagtccgccatcttctgggcggtcagcagggtggcgcgcatggagtcctcggtggcacggtagtcctccaccttttccaccaggaccttcagcttggccttcagcgccgcgttctccttgtagagcgcggtgtaatcatcggtgagctcgtccagaaactcatcgaccatggccatgttatatccgcccatcactgccttggaaaaggcgtgggtggaaacttcctgtggtgtcagcatagtgcgatgttaccccctcgtgtccgctcagaaatagaggccgttgttctccagctcgtcgatcagatcgccctcgatatccacatgatagggcgtgatgatgtatgtattggcagccaccttcttgatcttgccctcgccggcataggccacgccggacagaaagtcgatcagccgccgggcgatatccttgttggtggactccaggttcagcaccacggtccgcttgtccttcaggtggtccgcgatctcggaggcgttctcgaaccgctccggcttcaccagcaccactttcagctgggtggtggcgtggatattcaccaccttgttgcggcggtcctccaccttgagcttccggtcctcaaaggcgttttgccgcaccggctcctcaaagtcatcatactcctcgtcctcatcctcgtaggggtgggtccactttttcagttcgtccaataagctcataatagcctcccatcggagccgcgctccggtctttttcagttgtaatggcgggcgccgaagatggcgctgcccacccgcaccatggtggcgccggcacggatcgcatcctcatagtcgccgctcatgcccatggacagatattctaattcattatgaaacaatttttggttcatgtcaacataaagtgcctgaacttcctgaaaataccggaaattggcatccctctgcgcgtctgccgggggaatcgtcatcagtccccgcacccggacatgggtccgctccagggcggcctccgctgcggggaggactttctccggtgcaaagccgctcttggcagcctcccggccgatgttcacctccagcaggatgtcctgcaccagcccccgggccgcggccactttctcgatctcgtccagcagctccagagagcccacggactggatcagggccacatggcccaccacctgcttgactttgttgcgctgcaggtggccgatgaagtgcaggggggcgccgtcgtaggcgtgctgctccagcttctgtaccatctcctgcacccggttctcccccagggcgtcgatgccggctgccacggcctcccggcaggcggcggcatcgttcatcttgctggcgcccaccagcaggatctccttcgggtcccggccggcctcccgggccgccgcggccatgttcgcccggatccgggcaatgttctccgcaattgtcatcagcgttccaatactcctttccagcggccgccctgcggccatctctctgtcagctgccaatcacctttccatcatacaggtcataggcggtgatgatcacctcgtcccccgcccggaggcgaatctgctcctgggtcttgctgacctcctctgccgtgtccagcgtggagcgcaccagggcgaagtcatctccgctgtacagcacgtccaccggcttgaagcgggccttcatgcccaccatgcagtagacgccggtctcgctcaccacggactcgttcccgtcctcgtccgtaaccgttcgctcccgcacccgcagggcctccttgggcactcggatgcccgtggtggtctgccgaataacctcggcgctctgctggcgcagcagcgtcagctctgataaataggtgtccccctggaacaccgccaccacccggccgccttccgcctcgctgatatgggtcagcttcacgctcaagtcccggcccacgcccttggcaaagcgcagcttcagtctcccgctctcctgcagggtctgggcctcgctctcctccagggccgtcacatagtaccaggtgtcccccagcaccagtttgcccacccggttggagcgcagggactcgtccggctccagggccgccagggtcctgggcgtcagcgtctccaggctctccggcgttagaatgttctcatatccgtccaccacggcggaatagagccccgcctgcggcgcggtgatctgccggacagagcttcccgcctgggcccgcaggctgctcaactggctctggagctccgccatctgggcggacaggtcctccgtatcggaatacgtgtagtcccgcttcatcaccaggctccgcagctcggctccgcagtcctccgccgtgtccagccggtccgccgccagagcgccccggtagtcgcggatcgtctggaggatctgggcgtccagtcgcagagagacctccgcccccagcgccgcctcctccgcgtactgcaactgttcgatctgggtatggagggattggatctccttctggcggtccagcgtcgcctggtccgcgtagaccagcgccaccacgccgccgtcgctgatccgctcgccctccgcccgctgcagctgcagcaggccgctggtgtcgtccgtcaggatcgcctcgtcccgcaccacatagccggacagcaccgtggacatctccacctgatactggtaggcgatggtggtggtcagcgggtcgccgaaatagcgcaccgcctgaatcgagaaataggccagcacgcccagcgtgaccgctgccagcaaaagttttgtgccaagggttttctctttcatggttacctctttgtctctgtccgcgaagccttcccggccccatgcaggaccctctgcggaggcgcagacctccacaacctccagctccaccgccggacgcaccggcgcgatggcggaggtcgtgtgcttgaaatgattttctgcccgccagttctcatttccccaggcacggcgggctttgcccgccgtgctcaaggttttggtccgcaaaacgtgatcccggcctaagtgccgccctttaggcggcgggcctcaaaacgggtccgcaggccgctcatgcgcccgcgacggccggttcctcaccctccagatccaccggccgcaccggcgcgatggtggagatcgcgtgtttgtaaatgatctgctgccggccgtcgctgtccagcaccaccacaaaggcgtcaaaccccgcgatggtgccccgcatctggaagccgttcatcagaaacatggtgacgggcagcttgtcccgtctggcccggaggagaaacaggtcctgtaaattcgcttttgtctgcatatatgtccgctccttttttctgtatgagtcggacgatttccctgtctcccgtccgctcaccgctagaatacgccagcggcggccaggatttccgtcgaaacctggagggcccgggcaaaatcccggtctttttcccaccagatccagtgaatgtccggatttcgccgcagccaagtcagctggcgcttggcgtattgccgggagcggagcttcacctccgccacggcctcctccaccgtggcggtgccgtccagaacccccaggaactccttgtatccgatggcctggagagccgtggcctcccggggcaggccgctttccagcagctgccccacctcctccagcaggcccgccgccaccatggcgtccacccggcggtcgatcagggtcttcatgtccgcccggtcccggaactggaggccgatccacacggcgtcgtaccggggcggcaggtcccttgtctccgcgttgtgggcggagatggtctttcccgtctcccggtagacctccagcgcccggaggatgcgcttctcatccgccggatggaggcgttccgccgcctccgggtccacctgccgcagctcctccagaagcgggccgatgccctcccgggccagctgggcctggagctccctgcggacagcgccgccggcgtggccgccggcgaaggtccggccctgcaccaccgcatccagccacagcccggtgccgcccaccaggatgggccgctttccccgccgcagaatgtcgtccacgatggggacggccgcccgggcgtaccgggcggcggaccactgttccgccgggtctgccacggcaatcatgtgatggggcacgccctccatctcctcggcggtgggggcggcggtgccgatggtcatgcccttgtaaatctgcatggagtcggcggaaaccacttccccgtcataccgctttgccagcaggacacccagcttcgttttgccgcaggccgtcggccccaccacacagatgatcttctcagccatcgccgtctctcctctcgcctgtcaaggctgttccgcttctgatgcatcgatatactcactgtatacgatccgctcccggatgtaaagggggccctccgcaagcggacagcagaagcaccagtgccagcgcagccggcaatctcccccttacggcagccgcctccttttcagaagtcctccgccagcctgcgggccttctcacaggcctccgtcaaaatctcctccgtcttggcgggatccaggtccagtccgccggcaaacacatagctgaacgccgggatgccgaacatggcgcacagctgcttccagtacaggacacccagactctcgggctgctccagatccccgccggaggtgagataagccagcttctctgcccggcaatccccgtggcagccgtcggcctcgtagtgataggtcaggccattggcggagatgtactcaatatacgtccgcagggccgccgggaaggtcaggtcccagaagggtgccgccaccaccacccggtccgcggcccggaactggcgggccagatcatacaccggcgcatcgaagcaccggatccccgccagggcgtcccggtcgttcagcatctccggcgcaaagggcttcagcgccagcagggcctctggttccacagtctccacctcggcctccggatgcctggcctgccatgcgtccaaaaacgatctcgccagcaccagggtgcgggattcctcccctcgctggctgatgcagccgttgacaaacagcagtttcatgcaaatcactccttctcctccaaaagggtggtaatgatgggcttcccctcccggtccagcaggggcgtcatcccgccggcatggccggtggaatgccacaggtagttgaccccggtctcccggtccatccagacagagttttcctcaaagccggtgctctccacactggtccgcacaaaccgtttttccttttttgccatataggaaacctcctgaaaaattcgtcactcccatctccgccaggaaaaagggctggggaaaaccctgcggtttttcccagttcgttcgccgcgggcgaacaaagaaatctcaatcattttcggcagggcgtgtacctgccgaaaatccgttgacctgtgcgcctcgggcgcacacaccagtgaccgacgtcactggtgtggggggaggtcaaggggggacgcagtcccccttcgaagtctcacgcccgcttgaacatcttctccagctcgtacttcgtcagcttcaccgccaccgggcggccgtgggggcagtatttgatctctccgctctgcacccggtccaccagcacccgcagctccgccggatcgctgacccagccgcccttgatggccgccttgcaggccatggtatgcagcagcgcctcccgcttttcatccggggatcttccggtccgcaggcgctcggcaaactcctccagagtgggcaccgtgtcggcggcgtcgatgtccgccggcacctcccgcaccagcagggcgccggccccgaagtcctcgcaggcaaaaccgaactgctccagcaggggcaggttctccagcagcagcgccccgtcctcccggcttaactccgccgcgatgggggccagcagcgtctgtcgcatggggggctcctgagcatttttcagcttgtcaaaattcatccgctcgtgggcggcgtgcttgtcgatgagccagacgctgccgtcctcgctctcgcagatgatataggtccgcagcacctctccggcaatccgccagggtgcctctttcgtctccagaacagtcgtctggcccggtagatcctccgtcagcttcagccgctccggcgggatggcgggcacaaaggggcggggagcagattccggcgaggtcgtcttttctgcagggacggacactggggcagaggtccagggggcggagggagccgtccgctccgcccgtggggcggtcacggagacaggcggtctgcccagcgcacctttgttgcaggagggtgcaggcgggctgctttgctgcgtgtctggcggcgacgtcacagaggcgggcgcccttcccagagcgccctgggccgcggactctgagcgcttggtctggtaaaaagaggtctgcccgctgtccgccacccgggcgggcgcccgcagctcggtgttccaggcgggccgggccggagccgcgggctggggagcgggctttgcaccgccctgccggaacgtcttggcgtccatggtctggaagaagtcctgccgggaggccgccgggagccgcgcctcctgcgcgggagcggcggcgggagcgccggtcttgcccagggcatctagcaccgtgtggtagaccgcgtcgaacacatcgtgctcccgggcgaacttcacttgagtcttcgcggggtggacgttcacgtccaccgccgtcaccggcagggtgacggacaggacgcagccagggaacttacccttcatgatctggttgcggtagccctcctccagcgccgccgtcagcagctgggacttgatgaaccggccgttgacgaagaacacctgcatggaccgggagccccggcccatcagcggcgcggtgacaaaaccggagaccgtgatgtcccctccgctgccggacaccggcaccagcccccgggcgaagtcccggcccagggcagcgtagacggcggagtccagctttccgtcaccgggggtcagcagggcctccaccccgtccttgatgaacttgaaggagatgtccggatgggacagggccagatgctgcatgaggccgttcaccgccgcagtctccgcactgtccttgcgcataaacttcagccgggcgggggtgttgtaaaacaggtcccggaccgtgatggtggtgccctccggcgcaccggcgggctccactgcgccgggcacaccgccctccagatggagggcggctccctccgtcgtgccggtttggcgggtgaggatgtccacccggctgacggcggagatggcggccagggcctcgccccggaaccccagagtaccgatcttccccaggtcctcctccgtccgcagcttggaggtggcgtggcgcaggaaggcggtggggagttcctccggcgcgatgccgcagccgttgtccgtcacccggatcatgcccatgccgccccggcggatctccaccaccacggcagagctgccggcgtcgacggcgttttccaccagctccttcaccacgctggcgggccgctccacgacctcaccggcggcgatcaggtccgctacgtgggactccagttgttgaatgtgaggcatattggtttcctttctaagctcagagcagcagcacggcgacgatgggaatggtcacgatggacgccgccgtggtcaggaaggtgatctgtgccatgcactcggtgtctccgccgtactccatgctcagcagcgtcccgttcactgctacgggcatggccatctgggtgacagcgatccccagcaccagggagtcgatccccagcgcccggaggaccaggcacagggccaccggcagcaacagcaggcggatggccgtcagcagccacagcttgggagagcgcagcacctgtccggctgacatgcccgccagcagggagcccaccaccagcagggacagcggcacggtgatgtctcccacaaagtccagcatctcgcccaccagggccggcggccgcagccgggtcagcgccagcaccaatcccaggacagaggccacgatgcagggggtgaacagctgcttccagcggaagcgggcggcccctgccagcagcagcgggcccagactgtaagacaagagattgaagggcagcgccagaatggcggcatagaacagtgcgccgtctccaaacagggccaccgctacgggatagccaatgaaccccacgttggggaaggccagggcataccgccacacgcccttctgcccctgtgtgcccggcaggaaccggggcaccaccagggcaaagaccgcctccagcaggtagaacaccacgccaacctccaggatggagaggatggtccccagctccggcagctcctcgccggtgatcaccgccgccacgatcatggcgggcatggtgatgttcagcagcagcttggagaccttctggtccgcctccccgcccaggtaccccagccggttggccgcatagcccgccgcaatggcgaacaggatgaccagcatctcgccaaatacgtcccaaaaattcatctgtccctttctcccctcatcattccggaattcggttcttacgccacaagggtccaagcggagagggcgttggccgccgcatggagaccgatggacgtccacagggtgccggtgcggtcatagacccacgccagcaccagcccgggcaccagatactggagcatcagcaggaaatacgtgatgtcccggttcaccaccgcgaactgccacacatgcagcagggcgaacagcaggcagctgaccaggtatcccaccgccgcgctcttgcgccggagattcccgaacaccagtccccggaagagcacctcctccacaaagggcgccaggaaaatgacgatcagcagcgtcatgtggggcgcgtcctcgatctgggcggagatggtggtgtcgttcaggttggtctggttggataccaccagtcttgtcaggcggtacaccagctcgttcaggccgtacagggccaccagtccgatggccatgaacttgcaggccccgcccaggttctctgcaaagtgccgggaggtccgacccagaaagccgtggaaaatgatgaccgtggcggcgaagaggatgtagtaatacaggatattctgcaatccggtgctgatggtcactcccagcagtccgccgatcaggcggaacagcggggttgtgacaaagggcagcaccagtaggtagatcacaaagagcaccgtgcccgcgatctgttcccccgccgacatataggcggcgctctttcttcttggcatctcgttccctcccggttttcgtccggcttctgtttcagctcgttttccccggcgggcggatccgccggggtcttcttttgatccgctgggcttgggcggcgcgtgtccgcccgccgccaggcccctcatttccgcggaatcccctgtcccggcctgaaggccgctctccgggcgccgtcagcgcgtccggtcccccgcggcagagggcgcatcccgccgtgcctgcccggccgggtgctcagttgagcttctgcttccactcgtagatcaggctcatcgcctcaatgggcgtcagcgtgtccggctggcagcggcggagggcgtccagcacctccccctcgccgatggcggtgagggacacctggtcctcctctttccgggccgctacgtactgaacgccgttctcctcctccagctctttcaggaccgttttggcccgctggaccaccttgtccggcagccccgccagcttggccacctcgatgccgtagctgcggtccgccccgccggggaggatcttccgcaggaagatgatgtcctccccccgggtcttgacggcgatgttgtagttgaccgtgccgggcagggtgttctccagctccgtcagctcgtggtagtgggtggcgaacagggtcttggcccccagcagcttcttgtccgcgcagtactccagcaccgcccgggcgatggacatgccgtcaaaggtgctggtgccccggccgatctcgtccagaatcagcagagagtgcttcgtggcgtggcgcagaatgtccgccacctccgtcatctccaccatgaaggtggactggccggcggacaggtcatcgctggcgccgatgcgggtgaagatccggtccaccacaccgatgcgggcgctggccgccgggacgaaggagcccatctgggccatgaggacgatcagcgccacctggcgcatgtaggtggacttgcccgccatgttggggccggtgatgatggccacccggtcctccttctcccccatgaaggtgtcgttggggacgaagaggctgtccttgagcatctgctccaccaccggatggcggccgtcgtggatctcggtggccccagactcgtccaccgtggggcggcagtagtggttccgcaccgccaccgccgcgaaggacaccagggcgtccacctccgccaccgcggcggcagtccgctggatgcgggcgctctgggcggagatctcctgccgcagcgccgtgaagagctcatactccaatgccaccacccggtccgaggcggtgaggatctcgtgttccaagtccttcagctcctgggtgatgtaccgctccccgttcaccagggtctgcttgcggatgtaggtgtccggcacctggtccttgaaggagttggacacctcgatgtaatagccgaagaccttgttgtagccgatcttcagggtccggatgccggtgcgctccttctccttggcctcgatctccgccaggacgcccttgccgccgttcatgatgtgccgcaggcggtccacctcctcgtggtagccgtcccggatgaagccgccctcccggacggagaacggcggctcgtcgcagatggccgcgccgatgtgtgccccgatctccgtcaggtcgtccagctccccggccagctccgccagccgtccgccggagaaggccgccagctgggcccggagggcgggcagccgctcgatggcggagcggagggacaccatgtcccgtcccccggcggtgccgtagacgatgcggccgatgagccgctccatatctcccaggcccgtcagggcggcgatgagctcctcccgcgccatggtgctctccaccagggcggccacggcggcattgcgcttggcgatggcggtgacggacagcagcggccgctccagccagctgcggagcagccgcccgcccatgggcgtcctggtcttgtccagcacccacaggagggagcctctcttctcccggtcccggagggtctccgtcagctccaggttccgccgggcggtcaggtccaactccataaaccggccctgctcgtagtagtccaggtcgttgatgtgagagaggtccgtcttctgggtctcgtacaggtagtgcagcaatccccccagggccatggccgcggccgggttggtcctgggcaggcggtcaaacgcctcctccccgaactggcggcggatgtttcgctccgcctccgccaggcggaagcggccctcgccgccgttttccacccggcagcggaacttctccgtcagggcgtcggtcagggctttttccgaggcggccccgtcgttcaccaccgcctctgccggggaaaagcggcccagctcgttgacgacgtgctccacccggtccgggccggagaaggccgtcaggtgggtcttgccggtggagatgtcgcagaaggccgcgccggcgttctggctgtcgatgtagatgccgcagaggaagttgctggccttctcctccaggcaggcggcgtcaatcaccgtgccgggggtcaccacccggatgatatcccgcttcaccagccccttggccgttgccgggtcctccatctgctcacagatggccaccttgtagcccttggcgatgagccgggcgatgtaggcctcactggcgtggtaggggatgccgcacatgggcacccgctcctcctcgggcttggcgtgcttgccgtggtcccgggaggtgagggtcaggtccagctcccgggaggccagcttcgcgtcgtcagcgaacatctcatagaagtcgcccagccggaagaacaggatggagtccggattgtccttcttgatctccaggtactgcttcatcatgggggtgagttcggccaaaagggtcacctcattctctttctatcaaaggatttggattcgttttatgggggtgcgtcccatgggacgcgggaaatcagccatgtggatggctgggctgggcaggccgccgaacggcggccacaggggtctggctcccgccgggggcattgtccatgcgggatgcgccccccattttctttttgagacatcaaaaagaaaatgcgccgcgcccggtggaaaagaaaaaatgtctcggcgggtcggtctgcgcaggcgcagacctcctgccgccggcgggggaaggttggcaatcccgcgcggcggtcagagacggaaacgcccggcccttggggaaaccttcagcccggggaagtctgggatacacgctgcgctgattttcgctgccgctggccggtggttgatgaaagcctccgcagcgggccgatgagggcatcggcctctacaaccgcccgggcagcgcgtagcgaagcggaacgcgcggaaagagaagctggtcaaatgcgttcttgcaccccgacaacttccgcaccatccgccacgggacggcagtcggggaaatcgcagaagagcatagcgtgcccgaaggcaaggccaaatcggagcaggcactggtacgccgacccccgtacgcgcggagggccactgcaccggagcgcgcccggcgcctttttctcttacaccgggcgcggcgcgttctctttttggcgcaaccaaaaagagaatggggggcgcattgcccagctggcaccccagctgaatcccccgggcggttgataaccgcccctacggtcctgcaggggtccggcggaaatccggcgggcggacacacagttccgcccctaccgctcccggcagaccagctcatccagcgacaggccgtagaaatccgccagggcaatcagtgtggacagggtcggttcccgctctccacgctcatacgtctgataggcccgccaaccgatgccgatgatttttgccagctcggtttgtttcaggcccctttgctttctcagttgaagaaggtgttctgcaaacgtcataattcctcttccgctcttgacagacacaaatatgtctgctatgatacgtactataaaagacacaatcgtgtctgtcaaacaaattcaggagtgatcccctatgtccgattacatcgacatcctgctcaccgccctggaggacgagctgtacccctctctgggcaaggactacttcctccccctccagcaggcgaacgacgccttgaccgcgctttccgccaccctcaccgatcagcagcgtgcgctgctggattcctatgaggacgcctccgccgccgcaggcagcgcctatcaggacgcctacgcccgcagggccttcctcctcgcgcgggaggtctaccgttaaacggcctcgccgtacagcgcccaggtgttgctgccggtgacggccacatccgcgaactgcccgatcagggccttgtcccctttcagccgcaccagacggttgccctccgtccgggaggtcagggggtactccgggtcgtcgctctcgccgtccaccagcacccgcaccgttttgcccacataggcggcgtggagcttggcggacatattgttctggacctccaggagcctgtcaaaccacttctgcttctccgcccgggtggccgggtccggcatggccgcggccttggtgccggggcgggggagtagatgaaggtgaacagggcgtcaaaccccacctcctccaccagagacacggtgtccatggcctccgcctccgtctcgccggggaagccgatgatgacgtcggaggtcaataccagcccgggcatgacccgcttggcgtagttcaccagatccaggtactgctgccgggtgtagcggcggttcatctctttcaggacccggtcgttgccggactggaagggcaggtgcagctgcttggccacatgagagcttgcggccatcacgtcaaacagccggggcgtggcgtccttggggtggctggacatgaagcggatgagatattcccccgggatccggtcgatgtccgccagcaggtccgggaagtggtaatccaaatccagatcgttgccgtaggagttcacgttctggcccagcagggtgatgtccttgtaccccgcctccaccagctgccggacctccgccagcacggcctgggggtcccggctccgctcccggccccggacatagggcacgatgcagtaggagcagaagttgttgcatccgtacatgatggagacccaggccttcacgcccttctcccgcaccacggggatgccctcggcaatggtgccgtgctcgtcctggacggaaaagacccgcttcttcgtctcatacacctgccacaaaagctccgggaacttccacagggcctgggggccgaacaccagatccacgtggggataggactttttgatccgctccgacacccggggctcctgggccatgcagccgcacaggcagatcacctgctccggattctccttcttggtgtgggtcagggcgcccaggttgccgaacacccggtcctccgcgtgctcccggatggcgcaggtgttcaggagcaccagatcggcctccttcgggtcctgggtgagggtgaagccgcttgcctccagcatccccatgagcttctgtccgtccgccacattctgctggcagccgaaggtgtccacacaggccgcggggtgagcctcccgggcggcgaacaggccgcggattttctcctcaaactcccgctggcggtccaggtccgcctgggggatcaatacgttttcgcgttccaaatcagttcctccaaatgcagatactttaactaaaatatcatagcacaccagaaaacaaagcacaagcagaaacctccggcaggcagacagcggccccgccgggaacttcccggcggggccgctgttgtgtcacaggtctgccagcagatccggcaggtccgcggggcgggcggccacggcgtccgccgccgccaaatccacggacggggcgccgccccaggcggcggccacgcagaccacctccgccgcccggcccatggcccgcagggccgcctgggcattgcggccgaaggcgatgtccccggcgtggtccccgatgtaggcgaagcgcccctcccgaagccccagccggtccaggcaggccaggaaggcggcggggtccggcttctgacgggcgaagtccacgtccgcgtggcccaccacggcggcaaagcagtccgccgcgccgtgggcggccagggcggcgcggatgttgccgctgtcgttctgggagcagatgcccatgggggccagggcggccagacggggcagaacctccaaaagcccgccgaagaggggcggcagggtccggtccgccagctggcaggggccccacagggcccccgcctcgtccagccggtccgccgggacgcggagggcgtgctggtacagctcccgccagttgcgccagcggtagttggcggcctgataggcggccagggaggaaagcgcctccggcagcgggtccagcagggccgggtccaggcggccaaggacggccctggtgacggcgatgttcttcaccggcgtgttggccagggtgccgtcgtagtcccagagaatggctgtgaacatgggtgccctccttctatcgcttgtctgtgcggcccgctaaatagtccaagctgaccttgtagtaatctgccaatttgaaaaagacttccagcggtatcttgatctttccgttttcgtagtctgagtaggtgttctgtttcacaccgagatactccgcgatcactttctgcggtgtgtccgaatcctctcgcagttccttgactctcctcaaatacatgatgccatcacctcaagcgataacataccgcatcggtgaaagcgatattgacttatatcggtgtagccgatataattttcatgaggtgataaaaatggctctatatgagaaacgggatgacgtgtactgcggctcctgcggccactttacccggcactacatctggcgggacgggcggcaggcccggaacgcccccaacgggtgctttctgcccctgagcctgggccactgcgcccatccccgcatgaaggaccggcgggaggatcagtcctgccccctgtggatcccccgcaccccggaccaggacccgccggacacccggctgccgggtgcaaacgcgccggaccgctgagagcggcccggcgttgttctatcctcggttctccagcttccgcagctgggtctggaacgcctccggcaggtcgcaccacagctccaccagctccccggtccggggatggagaaaccgcagccccaccgcatgaaggcactgcccctggaggcccggcacgggctttttcgccccgtacaccgtgtcccccagaatggggtggccgatgtgcgccatgtggacccggatctggtgggtgcgcccggtctccagtcggcactccacataggtatagccggggaaccgctccagcacggaccagtgggtcaccgcgctccggccgcccgccaccaccgccatcttcttccggtccgccgggtggcggccgatgggggcgtccaccgtgccgctgtcctcccggagattcccgatcacgatgcagcggtaaatccgggccagggtgtggtcctgaagctgggcggagagcttctggtgggcgaagtcgtttttcgccgcgatgaggaggccggaggtgtcccggtcgatccggtggacgatgccgggccgcagctcccccccgatgccggagagggagtccccgcagtggtgcagcagggcattgaccagcgtgccgtccgggtggccgggggccggatggaccaccagccccttgggcttgttcaccacgatcacgtcgctgtcctcgtacaccacatccagggggatgtcctggggcgccacgtccaccggctccgggtccggcagggtaacggacacggcctctcccccgcccaggcggtagtttttcgccaggggctttccggcagcggtgacccgcccctcctcgcacagccgggcggcggcggagcgggtcacgtccggcagctgcccggccagccaggcgtccagccgggtgccggtgtcctcaggattcacttggagcgtccgcgtctccatgggccttgcctctcttgtcgtatttctcgtagaaccataggtaatagattaccgccagcacggcgccgcacaccacgcagatgtccgccacgttgaacaccggataggagggccagaactccaggtggaacatgtccaccacgtaccccagccgcacccggtcgatgatgttccccacgccgccggacaggatcaggaatcccgccgccacccccagggggtgccggacgatccggcggagcaggaccaccgccaccgcgatcacgatgacggaggtgaccgccaccagcagccagcgcataccggagaagctggaccaggccgccccgtagttgtggacggtccgcagctctaccagcccgggcagaaagggctgggcctcccccagggggatgttgacggtgacatagtgcttcacccactggtccaggcccagcagggccagggacagcgcggcgcaaagggcatacagcatagttttctcctcaaatcagataggttttcaccaccggcacccgccggaggaccagccacaccagaaagccgcccccgaaggccgcggccgccagcaccggcacgccccagacgggcggcagcgtcccggcggagaggcccctgcccgccaggaagtccaggaagaacaggtgcgtcaagtagatgcagaaggacgccttggagacggtctccgccatgggccagcggtcccggttctgccaccgggcggcgcagaagccgtacagccccgccgcctgcaaacagacgccgggggcgctcccctggaggaacacctgatacagcgccccggttttgacggaggccgccagcgtcaggccgaaggtcagcgccgtgcccgccaaatacagccaaacgaaggtccggggcctgtggcggggcgcctcctgagtcaggacatcgcccagcacaccatagcccacggcgcaccaagtcaggttgatggggtactgggcagggatgccgccgacgagggacaggggcgggaagaatttcagcgtgggggccagacaccccagcacgaaccagatccccagagcgtagttcagcagccgccggtccgccgccgccacaaggcggcgggtcaggggcagcaccgcgtacaccagcagaatgatgtggaggtaatagagatggttcttgtgatggaacagcaccagattcagcgccgcctgccggagggccgtccgctccagcacgcccgcagcgcgccagccccgcagcagctccacaccctcataggctgcggcccagaaaagcagggccgccaggatgcgggggatgtacttcgtccacacccgccggacggtgacctccttttccggcggcagcagcagcgcgccgctgcacaggaagaacaccggcaccgcgctgcgcagcaggcagttccagaacagggcggaggtccacccaaaggaccccggcgctcccgcaaagcccccggcggcggaggcatggatcagcagcgtgccgaagatggcagcggtcttggccgcgtccaccggcacgctgcggcgctgtgtcagcgtctgcatccgaccatctccctcattggacagatcgagcttgccgacaacagtgtacacggtttggcagaaaaaagcaaccgccgcttcacgccctcctgcggcgccgccacaggagccagataacgccggagagggccgtcagcgccccgcccgccgccagggacagccagaagcgcccgctccccggctgccacagcgcgccgcccagcacggtggcgcaggcaatccggggcaggccgcccagcagcccggcggagagatacgtgccgtagggcgtgccggaggcccccagatagaggctcaccacgtcccccggcgatgcccccgccagccgcagcagaaagacggacagccacgggttctccgcctgggcccggcagacgcccgccacccggggaatccgctccgccagggcctccagtcccccctgctcccgccgccccaggaaaaaggggatggtctgggccaccccggtgccgcagaggttcaccgccagcgccagggggaagggaaacagcagtccccccgccgccgtgagggcggacatgggaaagcagacggagaggctcttgagggcgtacagccccaccaggaacgacgccgccagaaccgtctgccggggggaaaaggcggcgatggcctccgccgtcaactgatggcggaacggccagagggcggcggcgcccgctgccagcaccagcagcggcgccccgtaccgccagacatgaaaggcatgtttttccatagccgtcctcccgcccgcgtcagatagggctagtatatgcggcgggcggaaaaagacgaagaggcagccggaaatccggctgcctctttctgcaaatagtgacagaattcccctggcggtcatacaaagggttcgtcctggggcaggacgtccgtggaaagttcggactccccagtggtcccggtgccggtctgcccttccgctgtctgctggccgtcctgctccggcgtctggatggtccagccattatccggcgtcgtgggttctgtaggctctgcggggacatcagggtcctggggctccgtgggctccaccggcgtggtgggctcggtggtgtccgttgggatctgggcgccgccgtcggcgggctctaccgccgggccccggaggatcaccttattgcgggacttgtagtcgctggtggcctcgtaagtggaggagatcagcttgccgttggcgtcgtagacattgcggtatgtccggtacttgtacccggtgtagggcgtggtcttgaccttctccgtgcccggcgccagggtggggtcgtcctcatacaccgtctcatagggcgtggtggagaggtgctcgttggtcatcttcacgctggtgccgtccacattggtgcccaggatccggaccgtcaggtaattgttttcatagatggtgacgatcttgatggggtacagggagttgttggtgaacttgtagtccggcccgccccaggacaccgtggcgtccatgcccgcggtgatataggcggggacgtagcggtgggcgtaccgctccgtgatctccaggttggaccgcaggcaggccaggtacagcgtggaggaagtctggcagatgccgccgccgatctcgtccaccgtctccccctggacataggcgggagccgcctgatagccccgggcggcggtccgctggcccaccacgtcattgtaggagaacacgtcgccgctgttcatcacatactcgttgatggatgcggcggacagcttcacattggaccggcgggcggaggtgccgcccacatgggtgcgggcctcgcccagcacgtcccggaacagcacctgctccagctcctccgccgtgacggcgggcagctccacctgggcggggacggtgacggtctcgccgggcgcggctgcgtccagcagccgctgggcctcgtccacatcgaagtccgctccggcctcctccggtacgatggcgcccgtctccttgtcataggaggcgttcttcaccacgccggagcaatcgtcgtagatctcctgggcggtgagggtcttggcgggaaggatccgagcgttgttcacaaacacgctggccgccgcgccattgccgctgccagtccatctttcctgtgcagtccgcgcaagatctgcggcggacacggacagtccgttcagggcttttgtgatttcgacggcatcctccgtcacctcgtaggaggcgtcctgggcctcccgggagaactgctcactgagctgttccatttttacctggaagatatcctcctccggctccagcacgacgcccagttgtccatctgctccgaccaggcaggcaagatactcccagcccttgacaaaaaagctgctccggccctgcacggcatcaaatgcggattgggcactgacctcatagtccagttcctctgtgatgcccagctcccgataggtgcatacggcgtcggggtctgcgccgtacagcatatctccctccggcgcggattccccatccccggtctcatcggccagcggtaaataaaactctacggtttcctccggaatctcctgccgcagccgctccgcggcctgctccgctgtgaggcctgccacgtccacaccattgatggtggtgttagggtaaaatatatccagggaattggcataggcgcacaggcccacataggcggcaagcaataccgccacaataactcctatgataattatcggctttttgccgccggttttcagccgcttcggcgcggtggcttcgttcgtattcggttccatgaagcccctcctgttgttctgtcggatcgcccagacaagccgtgctgtcctagcttatgcattcaggattttattttagcacgttttttctggaaaatggattacaatcccgtaacaatcagaagtttcaggcctctttccgacgctgtttcggaatgcggagcgtcagaacgatttcgtcctctgtctcctcccgctccgtccgggcgtccacacctgcgtcccgaatcagccgcagcccccggtccacactgttcaaaaacaatcgcacgtccttgatgatgtacgtccgccgtcctgcgggcggcgcggtctggagggctgccagccgccgctctacatactgctccgtctgggccacattccagtgcttcgccgccgcctggcgcagggcggtcagccgctcgccctcgtcctccagccgcagcaggcagcgggcgtgacgctccgtcaatccgtgttccaccagcagcgcccggcaggccggggacagccgcagcagccgcagcttgttggccagagccgagggggacatgcccagctgggccgccaccgcctcctgggtcatgcccgtctggtggagaaaggcggcgatggcctccgcctcctccaggtaatgcagatccttgcgctgcaaattctccacaagggccagcagggcggaggcccgcccgtccacctccgcctccaggcaggggacggtctccagacccgccagcacggctgcccgcagccgccgctcccccgccaccagctcccagcccgccgcggtccgccgcaccgtcaggggctggaggataccgtggcggcggatggattccgccaactcccggagccccgtctcctcaaaggtccgccggggctgcatgggattggggcggatttccgccgccgggagccacagcaccttccgttccggcctgtccatgggaccacctccgtttcatttcctttattttacaggtcctgttccaaaaaggcagggggaatctgtcgaggcgtcccccactccgcaggaaaagcggccgcccaatgggcggccgccatgcgaacactgcatattccattaccgggacggttcctccgccaggcgcgcttcgtaggccgcctgatccgcccggccgggcctggtggcccgcagggccttcacgatcagggccgtggtggcctggaggaacaccggagaaaaggccaccggaaacagcacgtctccggggaaataggcctcggccagcaccgccccagcgctgatgttccgcatcccggcgttgagggcgacagtctgcactgtggggaagtccagcttcaacagccgccccgcccaataccccaggaaaaagcccaacaggcacaggaagaacaccacgatcatcacccgcaccagggtcggtgtcaggttccggaggaagggcgcgcagccggtggcattggccgtgatgatgagcagcagggccgccttggcgggcagggacagcttcggcttcagcgtgaccgccacggcaccctttgtcagctggtacagcaccatggctaccagagccggaagcgccaccatcagcagcaggtcccgcatcatgccccaggtgtccagctccaccaccgagcccaccagcagcttcatggtcagggggatcaccaccggggagaggagtgtatccagcagcaccaccgagaggcacagggcggtattgccccgactcatgcccacccacatgagggacgccacaccggtgggcactgcatactccagcaccagcccgatggtaaacagcggcgcgtccggaaagcacagcgtccccaggcccagggtaatgaggggcatcaccacgtggagcaggccgaaaatcaccgccaccggcagagggtggcggaccacctgcgccagctcccggaagccgccgcccaggctgttggaaaaagtcatgaaggcgaacagccctaccgtcaccccgttcaggtgggagagcacctccggaaaggcaatacccagcgccacacagcagagcaccaccggcgccatgtgtccgcccaggaagccatccaggcggccgagcgttttcaaatccgatcccctcttttctagttcctgttcagcggcagagataggaaaaccagccctcagcgctccgtgtctccaggatctcccagccgttttcccgcaggcggtccgccacctcctgcgcccggtcgtcgatgatgccggagcagaggaacagtccgcccggagccagcatgggccgcaccagcggagaaaggccgatgatgacgtccgccacgatattagccaccaccatctgccagccgccgcccagatccgcccgcagaaccgcgtcccccagtacatctccgatccggacggtgtaggtgtcctgcccgatgccgttgagggcggcgttctcataggctacgtcccggcacttgtcgtcgatatccaccgccgcggcggaggccgcccccagcttcagcgccgcgatggagaggataccgctgccgcagcccaggtccagtacccgctcgccgccgcggatggtcttctccagcgccgtcaggcacaggcgggtggtggcatgactgccggtgccgaaggtgaggcccggatccaacaccagggccacccgcccggcggcaaggcccgcccggaccttggggtcctcccgcagccactccggcaccaccagcagccggtctccaatctccatgggcttgtaatactgcttccagttgttctcccagtcggcgtcctccaggtcatccagggtcatcagcagggtgccgcagtcgtcccgggtctttttcagctcctccagggcgatgcggacctcccccagcttggcgaagccctcgtcccccgcctccagatagaaggtgatccgggaccggccctgcatctcctgccgcaaatcctcgtccacatagtcccagtactgcccgttgttctccaggaagtcctcgaactccgtctcgtcatcgatcaccacaccgtcgatgcccagggcggagagcatcgtctccaccggctccagtccggtgtggtttgtgtcgatatgtacctccagccatttcacagccgtcacctcatctctccgccggagcggaattatatttgatctccagggaaaagcgcccctctgaagggacgcttttccgtccgtcctcaccggcggctgcccaggaagaacagggccagcgtgccagggccagagtggttgccgatgaccggccccacgtagttgatatagatgtcctgtacgccgaagcggcgccgcacctcgtccgccacaaactcagcgtctgcctcgcagtccccgtggctgatgaagatggtctgccccgccgggtcgatggcgctctccgccatgcggtccaccagggccagcagggacgccttccgcccccgggtcttgctgacgggcaccagatggcccgtgtcatccacatgcagcaccggcttgatggacagcatggtgccgagcagggccgccgcagcgctgacccggccgccacgcttcagatggttcaggtcatccacggtgaaccagtggcacaccttcgccttggtctcctccgcaaagacgtggacctggtcgatggtcttccccttccgcttttcctggacgcagaggtataccagcagcccctggcccaaagaggcgctgagcgtgtccaccacaaagatcttccgtccggggtatgcctcccgcaggtcatcggcggcgatcaccgccgactggtaggtggtggagagcgcggaggaaaaggccaggtacagcacgtccctgccgctatccagaatcttccgcatagcctcatcaaacacgcccacgctgatggcggaggtggtcgccagggcgccggcgcggagccgggcatagaagtcctggaagccgatctcccggccgtccaggtagttgtggtacacccggtcctccatattcaggctcaggggcagcacctccagctccagatccgccgccatccgggcggtcatgtcgcagcagctgtctgtcaggatcacaaaatcatccatgctcagtccttctccttttcctttttggcccgttctttgcttttggcgtgggcggcgcttgctgcctcctcccgggcctcctgccgctggcgcagcagcgtcacataccggctgctggccacgccggcggcgtagctcatcagagcaaagtggatggccgcatccgccagctcctcctccccggtgcggtcctccatctcatcggccacggcgttcagcgccttgttgaggctcccgcagaaggcggcgtacccgtcggagatgggccggtccccctgcagctcctcccggatcagcagatccatatcccgggtggacatcacccgcttcaacacacagatagcggtgagataggccaggtggtcccggttgtatttcttcccctccgcccggggcaccaggccgctcttcgtgtagttgttcaccatggcggcggtgaggccgtcatcctcgtcgaaccggatcacctgccggtccatatagctgagcacctggtccatatatagggagaagtccggcagctggtcccagggcaccgggcgctgggtccgcagcctctcccgcagggccgtcagatcatacatgcggatacactccttccgccgtgcggcacggcttttattcagaggtagtataccacgcaaatctgattttgtaaatcacgttttccagggtccggtattgcattttctgttagcagttattttcccacacagaatcgggaaaaaatgcgggagacaatctcctccttcgccgtgcggcctgtcagctctcccagcgcgtccagggcctcctccgcgtctgtgagcaccgcatccggggtcattccggtctccagggcctccaaagcccggcggactgcgtccagggcccggcgggcggcgtcctcctgccgccggtcggtcagcaggctgcccgcctcccccgggtccccggcgggaaacagggctgctacggcgtttcccaggtcctccagtccctcgccagtgacggaggacagggacaccacggcggcaggcggggccagagggccctctccggcgggaaagaccgccccagccgtccgcagcccccccgccatatcccgcttagtgaacaccaggagccaaggaactccgcaccgggccacatccgccagcagagatccctcttccgggtcctccggcaccgcaccatccaccaccgccagcaccagctccgcggaggcgatggctctccggctccgctccacccccagctgttccaccgggtcctccgtggcccggatgccggcggtatcgatgagccgcagcaggaccccgccgcagagtacggactcctccaccgtgtcccgggtggtgccggggatgtcggtgacgatggcccgctcataccccgccagggcgttgagcagcgaagacttgcccgcgttgggccggcccacaatagccgtgcggacgccggatttcagtacctgtccccggcggcaggtgtccagcagccgctccagccgcccagcggcggaccggagggcagcggcgatctcctccggccgcacatcctgaatgtcctcgtccgggtagtccaccaccgcgtaaaaccgggaggtgacttccagcagctcctcctggaccggctccagcacccggcgcaggccgccgtccagctgggcggcggcgtttctggccgcggcggcggtctccgcgtcgatcaggtccaccaccgcctccgcctgggtcaggtccatccggccgttcaaaaacgcccgcttggtgaactcccccgcctgggcctgccgggccccggcagcgaagagggcagacagcagctcccgcagcaccacgggggagccgtggcagtggaactctgcgcagtcctccccggtgtagctgcccggccccgggaaccgcaccgcaaggccccggtcaatgacccggcccgcccggtccagcatctctccgaacaccattttccggggctcctgggcggcaaagggacggccgccagccgcccggaacacccgcccgcacagggcgaagcacccgtctcccgacacccggacgattccgatggcggtggcggcgcttccagtggcgattgccgcgatcacatccatctgcctcacgctcccttcccgccgggacggttctcctcgccccagatgcacatagcgtccaaaatggggatgagggaccgcccccgctccgaaaggctgtactccaccttgggcggaatctggggatactcctcccgctgcaccaggccggccgcctccagctccttcagggagagactcagcgtcttgtgggagatggtccccaggcgccgcttcagctcattgtaccgcagaacgctgtactccgccagccagtagagaataatcatcttgtacttaccgctcaccagggacatggtgtagccgaagcccgtctcttcaatcccggtgcccgccgtgatgcatggctccattttatgctctccttttggttagtatcttacaccgatgtgcgtactttacaaacagagaatatcataggatactggggacatcaagaaaaaaggagcgattctgatgtcaaagcagattctgattctcaacggcagcccccgcatccacggaaacactgcggcgctgatcgacgcgtttactgccggagcggaggcggcgggccacaccatcgcccggttcgatctggccgctctggacatccacggctgccggggctgcctgggcggcggaagggatccccggcacccctgtgtccagcgggacggcatggacgccgtgtatccggcctacatggccgcggatgtggtggtgctggcctcgcccatgtattactggagcatctccggacaactgaaatgcgcctttgaccggctgttcgcggtggcggaactgggccccgatctggcaaatccggtcaaggacgcggtgcttctgatggcggcggaaggcgacacggaggagaatttcgccccggtgcgggcctattacaaggcgctgctggactgcctgggctggaaggatgcgggcattgtatacgccggcggaaacatggccgtcggggatatccaggcccatccggagcagctggaggccgcccggcagctgggcgcggcgctgtaaccgccccgcagttgtcctgacgagaacgaggacgggcgctggggcctccttgtgttttcgggtacgcggtgatataatgcagccatcaaaaccaaatgccgttggaaatcatgatgccgcccgccggttctgctttcacgactgacagccgcgccgaacgagccgcaaagatacagaaaaggaggaatacagcatgaaagcgcacgtttttgcgctctgtctgtcgctgtccctgtgcctagggttgcccctgcccgcgttggcctttgccagccccttcactgatgtgcaggagacctccccctactatgatgccattttatgggccgcagaaaccggcgtcaccaacggcaccacagcgtccaccttctcccccgatgcgccctgtacccgggcccagctggccgtgttcctatggcgggcggccggcgagccgaaacccgcgctggcagaacagcagttcatggatgtgacggatcccagcgcctactactacggagccgtccagtgggctgcagagaaggatatgtggggattcgggacctttgcgccccatgcggtgtgtacccggctggacgcggtattcttcctgtggcgcgccgccggcagcccggatatggaaggagaatttccctttgccgacgtccccttcggggacggagacggacacggacagcccctctactggtacgctgaccaggcggtgttgtgggcggtggagaacggtgtcgccagcggtaccacggagaccacattctccccggacactccctgtacccggggtcagatcgccacattcctgtatcgggccgctcaggcagagacttccgcgaagtagggaacgatgaactgcaggcaacgaaaaaaaggcggcggctgccagaggcagccgccgtctttcgtccaaagcgtccgggtacatgatgcgcccggacgcttccagttgacagggaatggaacaggatggagacctcgttatttgatccgctcgccggcggcttccttggccttgatctccttcacagcatccttgtgagagaggttgacacggcccttctcgtcaatgtcggtgaccttcacccacatcatgtcgcccaccttgcaggcgtcctccaccttctcgatccggtggtccgccagcttggagatgtggaccagtccgtccttgccgggggccagctccacgaaggcgccaaaggtcatcagccgcaccacgcggccgtagtacagcgcgcccacctccgggacgaacacaatgtcatcaatgcacttcttggcggcgtcgcagctggcggcgtccacgccggcgatgaagatggagccgtcgtcgttgatgtcgatcttggcgccggtgtcggccacgatcttctggatgaccttgccgccggagccgatgacctcccggatcttggaggggtcgatgtgcatggtcagcatcttgggcgcgtacttgctgacctccttgcggggctcggagatggcgggcagcatgatctgatccaggatctcgcaccgggcgtcataggtgatgtccagggcctccttgatgatctccatggtgaggccgtcgttcttcaggtccatctggatggcggtgatgcccttcttggtaccgcccaccttgaagtccatctcgccgtggaaatcctccacgccctggatgtcgatgaaggtggtgaaggagccgtcgtcgtcctggatcaggccgcaggagatgccggccacaggggccttgatgggcacgccggcgtccatcagggccagggtggagccgcagatggagccctgggaggtggagccgttggagctcaacacctcagacaccacgcggatggcgtaggggaactcctccacagaggggagcacgggcaccagagcccgctccgccagagcaccgtggccgatctcccggcggccgggggaacgggcgggcttggcctcgcctacggagtagccggggaagttgtagtggtgcatataccgcttctccgtctcctcccagatggtgtccagcttctggttggcggagagggtgtccagggtgcagacggaaagcacctgggtctggccacgggtgaagaggccggagccgtgggtccggggcagcacgcccacctcggcggccaggggccggatctcgttcttctggcggccgtccacgcggtggccctccagaagccactgcttgacgatcttcttctggaacttgtaggtgaactcctccaggtactggtccatatccggatattcctccagatacttctcgtgccacttctcgatcatggcgttccagcgggcctcccggatgttcttgtcgtcggtgtccatggcggccttggcctcgtccatgaagtccgccacgatcttgtcgaacagctcctggttgaaatccgcgtgaggatactcaaacttgggcttgcccacctcggagaccatctgatcgatcagggcgatgatcttctggttctcctcatgggccatcttgatggcctcgaacatcttgtcgttggggacctcgttggcgccggcctcgatcatgaccacctttttgcgggtggagaccacggtgacgtccaggtcgctgaccttgcgctgctcgctgtcggggttgaacaccagcttgccgtccacaaggcccaccttcagggcgcccacggggccgttccaggggatgtcggagatggccagggcggcggaggtgccgatcagggcggcgatctctggcgtgcagtcgtggtccacgctcatgaccgtgcacatgacggacacgtcattgcggaagtcggaggggaacaggggccggatgggccggtcgatgacacggctggttaggatgcccttctcgccggggcggccctcccgccggttgaaggaaccggggatgcggcccacggagtacagcttctcctcaaaatctacgctcagggggaagaagtcgatgccgtcccgggggcggggcgccgcagtgacgcagcagagcacccgggtgtcgccgtagcccaccatgacggcggcgttggccagctccgccagcttgcccacctccatggtcagggggcggcccgccagctccatctcgtacttgtggtagttggggaattgtctcttggtgataatggttgacatgtctggtctcctttttcgtatgatctccgcgggagccaaaccatttagcacttgaagcaacggccggatccccggtccctccttcaactgctaaaagatcggcctgcccgcgggcgttgaaagaatgcgggaagagggtggtgcggcaaaggcgcaccaccctccacattgactcacttccggatgcccagcttggcgatgagggcacgatagcgctcgatgtccttcttctggaggtagtccagcagacggcggcgcttgccgaccatctgcagcaggccgcggttggaatgcttgtcctgggggttgttccgcatgtgctcggtcagcacgttgatccgctcggtgaggatggccacctggacctcgggagagccggtgtccccctcgtgggtgcggttggcgtcgatgatcgcggtcttctgttctttgcgcagcatgaaaatttccacctttcttcatatatacccgcagggctgcgccccgggatcggtgaaagtccacggagcgaagggctggggccgcacatacacgtgctgttgcatgataccacagaaattcccagttgtaaagataaaaatgtggagttttccccggatcggcggaaaattccccgtttttgtcccccgaatgggcttgacaaaccgcttcttctcatgataatctaaccgtactaatacggttaatacagttgcaggggctgcaccgcggccccgcggaagggaaggtgagcggatgatcagcctgaattatcgggactcccggcccatttacgagcagatccgggacggactgcggaagctgatcgtcaccggtgcgctgagcgcggacgaaaagctgccctcagtgcgggcgctggccgcccagctggccatcaatcccaataccatccagcgagcttataacgagctggagggcgagggatacatctactcggtccccggcaagggaagcttcgccgccgcgaacgcggcggcggactccgcccggcgggcggagctgctgacccaggtgcgggagctcctctccgagctgcggtatctaggggtaagccagcaggagctgctgaatctggtgaaggaggcgagtccgtcatgatcgaagtgaatggcctggtgaagcggttcgacggcttcgcagccctggacggcgccgcgctgtcggtgccggcgggcagcgtctacggcctggtgggtcccaacggcgccggtaagtccaccctgatccgccacctgacgggcatcttccgccaggacgcgggcacggtgcgcatcggcggcgaggatgtgtgggagaacgccgccctgaaggcgcggatcgccgccatccctgacgactggtactacttccttcagtcctccattcgggatatgatgcgcttttaccgcggattttatcccgctttttccatggagcggtatgaaaagctgaaggaggtctttcagctggatgaaaaacggcctatccgccgcctcagcaagggtatgcagaagcaggcggccttctggctggccctgtgctgcatgccggactacctgatcctggatgagccggtggacggtctggacccggtgatgcgccggcaggtgtggtctctggtgctggcggatgtggcccagcgaggcaccacggtgctggtttcttcccacaacctgcgggagctggaggacgtctgcgaccacgtgggcatcatggaccacggccgcgtgctgctggagcggtccctggcccagctgcaggacaacatggtaaagctgcaggtggtgttccccgacgggatgacggaggtgccgtcggacctgccggtgctccacgccagccaaatcggccgcatccataccttcatcatgcggatgagcgcccaggaggcagaggaccgtctggcggcgtacagtcccctgctggtggacgcagtgcccctgaccctggaggagatctttatttatgagctgggaggtgcggactatgcagtcaaagacatcgtactttaacgccacgctgttccgcaagaacctgacccggttctggccgctgtggggcctggcgtcctttatcggcgctctgttccctctggcggtgctgctggatatggtgcaccggggctggaacgtcctctccgcaccggacttcaccggtatgtactatgatgcggtgagcgccgtgcccgtcatcaatctggtctacgccgccctctgtgccatggcggtgtggagctatctatacaacgcccgcagcgtggggctgatgcacaccctgcctatccggcgggaagggctgttcctcaccaacttcctctccggcctctccatgaccctgattccctacgcggtcaccggggtcctgtgcgtcgtggtctccctgtgcggcggggcctttgacgccaaggggctggccgtcaccgtcctggcagtgctgggtgagagcttcttctacttctccagcgccaccttcgtggccttcatcaccggcaacgcctttaccatgccgccgctgtacgccctgctccacttcctggcggtgctgctggactggctgatctcctccttcgcccaagggttcatcttcggcttttccacttattacaccggggtggtggaatggctctcccccaccgtgtatctggtcaacaacgtccggtgcgcccggcagtatgtggaggtccagcagacgttccccgatggaacgccttacacctcccgccttttgacctccgcagacctggagagcttctggctgatcggcgtctacgccctggtaggactggcgctggctgccctggccctcatcctctaccgcaggcgccgcagtgagaccgccggcgacgtggtggccgtgggctggctgcggccggtgttccggtacggtgtggcagggctctgtgccctgctgggcggccagttcctctactccctgttctggtatggcttccagcagggggaatactacgacacgctgcccatggtggtctgcctgctggcggcaggggccatcgggtattacggcgcctccatgctgctggccaaggccttcaaggtgttccggggcagctggaagggcctgggcattgtgctggcgggctgtgccctggtctgctgtgtgctgcatttcgacctgctgggtgtggcggaccgggtgccggaggcctcccagatccagaccctggagatccggattgccgacaacacctacacgctcacgccggagaaggacgcggacctgctggagcaggtcagggccctccatcaaacggtggttgccgacgaatcctatgttcgggagatggaggcccgcagatcttccacctggtctgaggatgagacccccaacacggcatacaccggcctgaatctcacctatactctgaaaagcggcacccggatagaccgctggtactccctgctcattacccgggaccgactggcccagccagagacctatgattatctgctggaccagttcgtgaacagcgatactgtaaaagcccggcgcctccatctggatgacgatttctggacggtgagcggcggcagcctgtacattgacactcgtggcgagggctacgaactgggcagccgggagggtgacgccattctcaaggcagtgggccgggatctgaccgccgggaactggggggattacgactggttctccggcgacagcggcagcagctatgccatggacctggggctggactttgaaagtgcagacaaggagcgttacgactggatctctgtccatgtgacccctgccatgacggagacggtggactgcctggagcgcctcggcctggtgacgagggcagatctcgtcacctaccggcagctgtatccggaggactatggggcggacggctcctccatctggcaggaggttccgcacacgggtgagaatgcggtggtctacacggaggacaccacttccgccatggtctccccggcatgaggggggcaagaacgcggcggcgccggaatccccgttttgccgctttatgcctgctgctgatctttgccgctgtgggcgccgccgtctggctgtgggccggccggggccttccgggagagggcgtggaggtgccggactatgtgcaggcggacctcctcaccgtgaacccctggtcccggcccggcacgcccctggagaagatcgatgggattgtgatccactacgtgggcaaccccggcaccacggcgaaggccaaccggaactactttgaatccctgtcctctggggagacggagacatacgcctccagccacttcatcgtggggctggagggtgaggtcatccagtgcattcccctgacggagatcgcctacgcctccaatatccgcaacgaggacaccgtggccatcgaggtctgccacccggacgagaccggggcattctccccggccgcctaccagcaggtggtggagctgacggcctggctgtgccggaccttcgatctggatccggacactgatgtgatccgccactacgacgtgacggagaagctgtgtcccctctattatgtggagcatccggatgcctgggatgccttccgggcagacgttgcagcagagatggagcgccagaccgaagtctcctgacacggagcttcaaaaattttttggtcctccgtgaaacaaaacggcattcttgatcgtcttataaagcagagggagattttacatcaaagggggcctttttccatggagcaaaatccggctgccgccacgctctggcgcatgtgggtggataccaagcggcgcattgtctccttccacgaggagaaggactgccagctgctggagttccgcagccacgagatgtttttgagctgcgtggaccaatacgcctgcaagcaataccgttatcaatgaccctgcggggccttttcgtccatatcccggcggcttcagccgcctaaggaggctttttgatccatgtggcaaaaacgcgggccagcactgctgtgtctcctgctggccaccgcactgacggtctttgccgccgcccgctcccccgccgctccgcccggcgaagtccctcctccgcagacgctggaggaggaatccctgctctatgaagagacgccggtccagattatctccctgttggacctggagccggtggatacccgggcgtctgccaatcccgtccgggtggggggcggcaccctggaccctgtggaccaggcggagatggcatccgttctggcggaatgtacattaaaagacaacaccatcgtcaggctctacgttacagcggagggcctgatcgatggcgcttttttgcgccctggcgccgggtggatccgatttgcccgcctgtaccgcggcgcggaccagggccccaattacgcggaaaccgccgcccttaccgcctgctccggtattctggggcacgatggctttctgctgcggaccgacgggcactgctccggcgtttactcctatgattactactggttcgacactgccggggacttgcaggtcctcaccgccaggatggacccggtggccctggacctggacggggacggaacggcggaactggtctgggagatcgccgagtggcagggcgcgttttccttttacttccggcggacagacggcgccatctgttgtgtgacgccgtccgaatacatcgacgcatcgggcctgttcctggctgcggtggagcaggaggggcccggcccggtccggctgatctaccgctatcacggcacggacgaggatcaggaacagttctgcgccgtgacgtttcgggacggtgccctggagattgagatggaccttgtctatgtcccggcctcgctggaagacacagtccccctttcagatcccacagctggcggggccgccctgccccatgtgtccattaccggccccgacggctggaccatggacggtgccggggaggcggcctatctggatctctggtcccttctctggaacagcccatatccctcctcgaagggggcggtgatcgtccccaccgatgcgccgctggatgcggagaccacctataccgtcaccttctccgatccgcaggccgggaactccttttcctggtccctggacgccgagggcatctgccgcctggacggcatagagggcaactgccggatggtgtccaccggtgtcggctccctgcccgcatactgtcacgatgtgctggagctctactgccgggccagccgcaccgcccggaactatgacgcgcagggccgatggctgggatgggatttggtcccggatacggtcgccccgggctaaaacgggtatcttttgcaaaaaccgccttgacaaacggcgaaaatgtgatacgatagtccggtaaatggaacattccggcgtggaaaaggacgagtaaccggcatccctcctgcaaagagagccgccgtttggtgcaaggcggacgggagctgcggcgaaaatcaccttggagcctcctgctgaaagacgacgcgagtaagcgtggacgattgatgcccgttacagcatcggcccgtggcagcgggctgtgaggggctgtttcccgcaagggcgcagcagcgagagtggtaccgcagagtgtttgcaaacgctttgtctcttgaaaaagaggcaaggcgtttttgttttctgaagggatgtgtattctggtgaaatgcccaaactgcggaaaggaaatggaagagggaactctgcacacccggaattaccctttctggacgcagcaggagctccgattctttcgggcccccacagacaccgtggagctgggccccattggcgatgacaccaccagcgtgtttacacgggatccgttcccggaatttccccatgccatgctctgccgggaatgcggccttgtcaccttcccgtgcagcttgattgaaacctccaaaaaagatagcaaataggagctggaacaggaggagctttatgaagtgtccgtattgtcagcagcaaatgcaggagggctttctcagcagccgctcccccgttttctggtcagaggaggtgtcaggccttccccttcccgccaggaagggagatttgcttctgggtggaaagctggggctggttgtccgcccccgggcttacctctgccggagctgtaaaaccgtcattacccaatatcaataaaaattcagcaaacagaatggaaataggaggaaagatatggactacaacaagaccatcaatctgcccaagaccgacttccccatgcgggcgggcctgcccaagcgggagccggagatgctcaagcgctggcaggagcaggacgtgtacaacgagctgctgaagaagaacgagggcaagcccctcttcaatctccacgacggcccgcccttttccaacggcggcatccacatgggcaccgccatgaacaaggccctcaaggatatcatcacccgatcctacgccatgcggggctactacaccccctatatccccggctgggacaaccacggtatgcccatcgagtccgccattatcaagcagaacaagctgaaccacaaggctatgagcattccggacttccgctccgcctgccatgactttgcccagcattatgtgggcgtgcagatggacgccttcaagcgcatgggcgtcatcggcgactgggagcacccctacctcaccatgaaccccggctttgaggctgaggaggtgaaggtgttcggtgccatgtacaagaagggctatatctacaaggatttcaagcccgtctactggtgcccccacgacgagaccgccctggcggaggcggagatcgagtatcaggacgacccttgcaccactgtgtatgtgaagttccccatgcacgacgattgcggaaagctttccggttatgacaagctgttcttcgtgatctggaccaccaccatctggaccctgccgggcaacctggccatcgccctgcatcccgacgagtcctacgctgtggtgaaggcccccaacggcgaggcctatatcatggccgaggctttggtggagaaggtcatgcacttgggcggcttcgacacctgggaggtggcggagacccatcccggcgccttctttgagaacatgctggcggaccaccccttcctgcccaagacctcccgcctgctgctggcggattacgtcaccatggactccggcaccggctgcgtccacacggcccccggcttcggcgcggatgactacgagacctgcaagcgctacggcgtggagatggtagttcccgtggacgaccagggccgccacacggagtacgccggcaagtacgccggtatgaagaccgatgagtccaaccccgtcatcctggcggacatgaaggagagcggcatgctcttcgccagcgaggacatcatccacagctatccccactgctggcgctgcaagggccccatcatcttccgggccacgccccagtggttctgctccgtggagtccttcaaggaacaggccgtcgccgcgtgcgacgatgtgcgctgggtgcccggctggggcattgaccggatgaagtccatgatccgagagcgcaacgattggtgcatctcccgccagcgcaagtggggcctgcccattcccgtgttctactgcaaggactgcggcaagcccatctgcaccgatgagaccatcgacgccatctccaagctcttcgccgccgaaggctccaacgcctggttcgccaaggaggcggaggagatcctgccggagggcttcgcctgcccccactgcggtgccaaagccggcttcaccaaggagaccgataccctggacggctggttcgactccggttcctcccacttcgccgccatgaagaaggaccagggcttctggcccgccaccatgtatctggagggcctggaccagtaccgcggctggttccagtcggcgctgctgaccgccgtgggcgccttcggccagggcgcgcccttcaaggagtgcgtcacccacggctggaccgtggacggcgagggcagagccatgcacaagtccctgggcaatggcatggacccggcagagatcatcaaccagtatggcgcggacctgctgcgcctgtgggccgccagcgccgactaccacgccgacgtccgctgctctcacgagatcttcaagcagctcagccagaactacctcaagttccgcaacaccgcccggtactgcctgggcaatctggacggctttgacgccgaccagctgacggcgcccgcggagatggaggaactggaccgctgggccgtcacccgcctgaacgccctgatggagaagtgcgccaaggcgtacaacgactatgagttcctggtggtcacccacgcggtgaacgacttctgcgtggtggacatgtccaacttctatctggacatcatcaaggaccgtctgtactgcgaggaaaaggacggcgccaagcgccgcagcgcccagaccgccctgttcctgattctggacaccatgaccaagctgatggcccccatcctgtgcttcacctgcgatgagatctggctctctatgccccaccgcagcggcgacgatggtcggaacgtggtgttcaacgacatgaacaagcccttcaccgactacgccctggatgagaccgccatggagaagtggtccgccgtggaaaagctgcgcgacgacgtgaacgccgtgctggaggccgcccgggccgagaagaaaatcggcaaggccctggaggcccacgtggccctccacgctggggacgacgcggcgtctgccgccctggtgcaggtgatgggcctgaacctggcagagctcttcatcgtctccgactgccaggtctccagtgcggagcccgatgccgcctccactgtgggccagggtgccaacttccccggcctcaccgtggaagtcagcgaggccagaggcgacaagtgcgagcggtgctggatgcacagccccactgtgggcgccgacgcggatcaccccaccctctgcgcccgctgcgccgccgtggtgcggaaactcccccagttctgaccatccgaaaacagcagtcaaaaaggtcccggccattggccgggacctttttccatgtcgattcaattcccccgggcacgttcctttttcagcttccggatatcctctcccgcaaagggcagcagggtatattccccttcaatccgggaggcgatctggggcgtgtaccgccgggccagctctcccggcgtcaggtttgtgctgatgatggtggagcggcgctccatctggcgggtgttgacaatctggtacagggcgctctgaacgaaggatgtggtcatctcggatcccagatcgtccagaatcagcagatcgcagttcagcacccgctccacgtggtcgtcggcctcctcttcccgggtgaacttctgctgctcgaattgtgcaaagatgtggcccgcggtgtcataaaccaccgaatgccccttctcgctgacctcccgggcaatggcggcggagaggtgggtctttcccagtccgggtgcgccgaagagcaggaggttcgccgggcgcttgccgaactggtgggcaaaatccgcgcagatgtcgtagatcatctccatgtgctgccggacggtgatgccgatgttcgggtcatagcggtccgggtaccagtctgtggagaaggtgtcaaagctctggtgccccaggtccagcatccgggacagctccttctgctgctcccgggcgtaatagccccgcaggcagcggcacacccggccgttgcggtagcccgtgtccccgcagagggcgcaggcgggcgtctcctccagagcatcctccggcaggcccatcttctgcagaagctcccgcttctctgcctggaggctcagattttcatcccgcagcactgccaccgcggaccgggggtccgtgccgtggcggagcgcactggtgatgatgcggctcatggtggagcgaagctccccgtcgatctcccgcaggcggggctggcgggcaaaaatccgttcccgccgctcctgatactgggcctgccgcctctggcggtcctcctcgaaccgctggagggccaagcgcatcacctttccgtcatacgccaccgctcatcacctcctgttccgatgcagctcctgcatatatctgcgcatctccgtctccgtgtccctgggggactgctggtcccccctgcgggccgccgggcggtcccccgcctgaatctcctccaccgtgtggaggcccgcctcgttccacttcttcaaaatgccgttgcaataggcccacttcagctcatggcacttcagcaccgttttgtcataggccagggccacggcctccgggccaaagcccatctcctgccaggcgaggatgtacttctcctccgaaggcgcgggggccggtcccccagctgcagcgccttcatatactggggcaggaccccctggcgctgggcataggtccggagataggcatccgccgccgcctgggtgtcgatccccatgcgggcccaggcgtagccctccttttcgatctgcttcatgccggggcggcggccctcgccgaatcggcgctgcacccgctctacacagtggcacaccagcagatagaccacgccttccggcaggcccagatagtccgtcagtcccagcaggatccccacgtccggggtggtcagctttttgcccagcttcacctccacctgccgggtgagggcctggaacgccttgctgtgctccagccgctccgccacgtcggcgcgctgatagacgggccgctcctccgccggggcgggcggcgtctccgcgggggccaccaggcccagctcccgcagggcggtctccgccgcctcgatgcggccgcggtcccaccgcagctccccggccagggaccggggcggtaccgtgccctgccgccgcagcagcgccagatacagcagcgccgcatccccgtcgccccggtccagcagccgcttcaccgtggccgcggacagggtgacgctctcatccccggtatgtaccagacagctgggcatcctccgctcctcccctctttttgaacttcccctattctacacgattttccccggcaggacaagccccggcggaaaaagtccgcacctgccccagcttctggcggaaatgtgaatttttttaaaacctcccgtttttctgtggcgctgtcttttttcctatgatatactataatttatgataatgggcggcatctgccctgccgctgatcaatctaccgacgagggggaagttgtttatggcaaatcgcgtggtcatcaacatctgcggggaggagctcaccttcattgcggaggagtcctcttcttacatgcagcgggtgggcgcctacgtcaatgataaaatggcggaggtcctggacagctccaaagtgggccgcacggatgccgccgtcctcaccgccgtcaacattgccgacgagctcttcaaggcccaggccgcggcggagcagctccggggccagatcaaggggtatctggacgaggccggcagggcccagagcgaggccagcgagctgaagcgggaggtcttccgcctccagcagaagctggacgcccaggcccggaaggaccggggatgaggccggagctgctggcccccgccggttcgccggaggctctgcgggcggcggtccagaacggcgcggacgcggtgtacctgggctggggcgccttcaacgcccgtaggggcgcgaaaaatttttctgatgaggagttcgccgccgccctggcctactgccacgagcggggggtccgggtctttctgacgctgaacaccctggtgacggaccgggagctgccccaggcgctggagacagccgttcaggccggccgcctgggggtggacgcggtgctggtgcaggactgggggctgttcggcctgctgcgccggacgctgccggatctgcccctccacgccagcacccagatgagcctgttcacctccggcggtgcccgggagatcgccgccgacggctgcgagcgggtggtcattgcccgggagtgttcggcggaggacacccgtacgatctgtgaaaactgccctgtggaagtggaggtctttgcccacggggcgctgtgcatgtgctactccggccagtgcgggatgagcgccctgatcgggggccgctccggaaaccggggccgctgcgcccagccctgccgcctgccctacggggttaacgcccccgccaaaaaggcatatcccctgagcctgaaagacagctgtctggccggacggctggaggagatgggggccatgggcgtatcctgcgtgaagctggagggccgcatgaagcggccggagtatgtggccgtcatcacccgcatctacgcccgcctgctggaggagggccgtggtcccaccgccgacgagcgggcggagctggagcaggccttctcccggtccggcttcaccgactggtactggcagggcaaacacggcgctgccatgttcgggacccgtccggagaacgctccggaccccaaggacctctttgaggaggcccgccgggcctatgaacgggacagcctgcggacggtgccggtggatctctcctgctccgtttccgcgggggtgccctgcaccctgactgtgtcggaccgggacggccacagcgtcacggtcaccggcccggtgccggaggccgcccggacccgggccctggatggactggagctggaagcccgcctccgcaagaccggcggcaccgcctaccgctgcgacaccgtggtcaccctggtagatgaggggctgtccctctccgccagtgccgtcaatgccctgcggcgggatgcgctggcggctctcaccgccgcccgcactgcgccgcccaagcgccgggagctgccggtgccgcccctgccggaggccgactgcacagcggaggcgccccggctcaccatttccgtgacccggctggagcagctctcccccgccctgctggagctgggctgcccggcccgggtctatatcccgctggaagaggtctcccggctggaatctctcccgggagaaggcccggagtggtgcgccgttctgccccgggtctggcgggaccgggacgagcctgcgctccgcaccttgctggagcgggcccgggctctgggctttaccggtgttctgatcggaaatctgggccatctgcccctggtgcggggcctggacttccatctctacggcgattacggcctgaatgtgttcaattcccggtccctggcctatctgaaggacaaggagctggagagcgcctgcgtgtcctttgagctgcggttcgcccagatccgggatctgaaaaaggtgctgcgggcggaggccattgtctacggccgcctgcccctgatgattacggagaactgcctggtgcagaacgagaccggctgccgcctggaccggcagggcctttgtgtcccggaggacggcccctgccgctgcggccagcccaatgttctggtcgaccgcaccggcgccgcttttcccctgctacccgcctacggccaccggacggaaatccagaacagcaagccgctgtatctggcggaccggccggagcaccgcaggctgggactggcctatgcccgtctccgcttcaccacggagacagcggaggagtgcgtgtccgtcgtgcaaaactatctggatgccgcgcccgccgcgggggatttcacccgggggctttacgaacggggagttgaataatcaaatggcagcctgtatagatacccgctggttttggacccttttgatccttaccctctgcggagagtttctgcttccctgcctgctggcccggaaggatccagcctatcggcctggaaccatggcggtcagcgttctgggcagaaggggcggtcccgtggcccgtgtctaccgcctgtggctggcgtggctggggatatggcttttgaccactgccgccgtctacgccgtcggcgcggcgccggcctcccggtggctggcggcgggattggccgtgtccctgggcggcttcgccctgggcgccggtatcctggctgccctgtttcccaccgggctcaccaaagatctgtcggatcgctctgccctgatccacggcattgcctctgccctgggctttttcgccctgctgttcctacccctctggcgggcgctgctggcgctggagacagactccccggttatggcgtgggcctgctttgccgccctggggctggcgctggtattcttcacgctgtttgtcctctcggacaaagaccgcttccagggcacggctgtggcccgtgagggtctttgggaacagctctgcctggcggccatgtatgttcccttgttgctggatgcaatcgtccacctgatttccgccccctgagctgtacagccctccgcacggaaccttacactgataaaagcagggatgcatctgtccgcccatcagcgggacttgtctcctgcatccaatggggttaaccgcctgaaagcatcatatttcctatacaattcataaattttattctatattatacaaaccgtatttattttggagtttgacatggaagagatcaaggtaaaatatttcacagatgacatcgacgagctgtgctacgtggagggcaagtccgactggatcgacctacatgcggcggaaaccgtgactatgaaggccggggagttccggctgatccccttgggggtggccatcgccctgccggaggggtatgaagcccacatcgtcccccgcagctccacctttaagaattacggcattctgcagaccaactccatgggcgtggtagactacacctaccggggcgacggtgaccagtggcggatgcccgcctacgccacccgggatgtgaccattgagaaaaacgcccggatctgccagttccgcatcatgaaaaaccagccccggctgaccttcaccaaagtggagcatctggacggccccgaccggggcggcttcggctccaccggaaagtgagggcgcggccatggcaaagatcgtactggcctccggctctccccggcggcaggagctgctccagcgcatcggcatcacggacttcgacatccgggtcccccggacggaggaaacctatcccgccggcctctccccccgggagacggtggagtacatctcccgggagaagtccgacgcggccgccgctctctgcacaccggaggaaatcatcatcactgccgacaccatggtgtttctggacgaccagcgtctcggcaagcctgtggacgaggcggacgccctgcggatgctgacggccctccagggccgccgccacacggtatgcaccggcgtcaccgtccgccggggcggcgagatcctgacggagagcgcgtccaccgacgtgtatttccgccctgccgcggaggcggagctctggggctacatccgcaccggcgagcccatggacaaggccggggcctacggcgtccaggggctgggtgcccttctggtggagcggctggacggtgactttttcaacgtgatgggtctgccggtcctgcgcttgagccggatgctggagcggttcggcgtccatttcttctgctgaccaacgatcaggagggtttcctttgaagaaattttttcgggaacacggcatctgggtcctgttcgccacggcggtgatcgccgtgagcctgtccctcatgtcctttttctccaacacctcctctcccctgtccaatctggcggggatcatcgcctcccccttccggtcggcctacaccgctgtaacaggctggatcacagacaagcagaactactatcaggacgtcaccgccctggaggaggagaacgccgccctgcggcgggaaaacgccatcctcaaggcccagaaccgcctggctcagaccaacaatgaggaaaacgcccgcctgcgggatctgctgaacctgcggccccagaactatgacctggagctggagacggcctccgtcacggagcgcacggtcaccaactggacctcctccctgacactgaacatcggcacggatcacggtgtcgaagtgaacgactgcgtcatcgacgagacgtatgccctggtgggtgtggtcagcgaagtgggactcaactggtgcacggtcctcaccatcgtggacacggacacctccctgggcgcccaggtgttccgcaccaaggacctggggctggcggtgggcgacttctccctgatgcgggagaaccgcctgcggctggactatctgcccgcggactgtcagctgctgggcggcgatctggtggtcacctccggcctgggcgggtattatccctccggcctctctgtcggcacagtggaggaggtgcagctcagcgactccggcgccgcctcctacgcggtgctggaacccgccgccgactttgacagtctggtggaggtcttcgtcatcaaatcctttgacatccagacctgatgggacggatgtccccacctgttcggaaaggaggctccggcattgctggcgcggaatgagaccattttcaaatgggccctgtatgccggggccacggcagtgttcttcctgctccagggggcggtgctccagcggatcaccctctggggcgtcattccctttgtgttccccatcctggtggcggtcctgggtatgtatgagggtcccctccccgcctccgtctacgccctgacggtgggagtgctgtgcgacctgctgctgccggcgtccatcccctgcttttacaccctgatctttcccgcggcggggctatgcgcggcgctgatctcccagagcctgctgccggcaggctttctctgtggggtggtcacctccgtgctctccttcctccttacagacgcctttcactgtatcgtgctgtgggctggggggaaagccgcctgggctgcgggggcccaagtcttcctgcgggaggtctgcgtctccatcctgctggtggtcccggtggtgctgctgttctctgccgtgttccgccgcacccacctggacgactgagaaggaggctgtctatggaccataaggaagcccatcatctgcgcctgtatgttctggcagccctgtttttcattgtggctgcggtctacatcggggtcctgtacgatacgcaggtgaacaattacgactattactacgccagctccgtccgcagcatcgcccggtcggagaccgtggaggccgcccggggcaacatcaccgaccgaaacggcaaggtgctggtgtccagccgctcctcctacaacctgacctttgacgcctccctgctggagaaggacgaagatgccaacgagtccctcctgcggctgctgcagttgtgtcagagccgggggatcaactgggtggattctctgcccatctcccgctccgcccccttcgcctacaccatcgactccctggacagcgccgccaggagccgctttctcacctatctgaaggatctggacgaggccgcgaacgccctggccgcctatctgctggagcatcctgccctgctggagaccacggacgaggagggcaacagggaaaaccccgccgacgacatcctggcggatgaggagctggatcaggccagcaaggcccaggccctgctggaggagctgacctccagtcagctgaccggcgccatgctggaagggtccggtctctccgccacgcggctgatcgccctgatgcggaaggatttcggcctctccgcctctttttccgtggaggaggcccggctggtgctgggcgtccagtacgagatccgcagccgaaatctcgccaggacggacccctatgtgctggcggaggacatcgacgcggagctgatctccctgctgaacgacggcgactacgccggagccaagatcaccccctcctccgtgcgggagtacgagacgacctacggggcgcatatcctggggtatctcggaaaaatcaacgacagtgcggaaaaggaggccctgggcgagggatataactggaacgactatgtgggcaaggacggcgtggaggcggcctttgaatcccatctcaagggcaccgacggcacccgggtggtctccctgaacgaggacggcaagatcaccggcgagtattactccaaggagccggtgcccggcaacaccgtggagctgaccatcgacctggacctccagcaggcggcggaggacgccctggccgccaccatcacccggatgaccggggaggatggggatgagacccggggcggcgccgtggcggtggtacaggtgggcacgggggaagttctggccctggcctcttatcccacctatgatctctccacattccgacagagcagcatctacgcggctctctacaatgaccctgcccgccccttcacaaaccgcgccaccaacgggacgtacgtccccggctccaccatcaagcccctgacggccgtggccgcgctggagaaggggatcattactcccacccaggagatctactctcccagccggtgggtctatcccaacgaccccacccacagcggcgccaactgcgccggcggcaaccacggtctcatcaatgtgacggaggccatcaccaagtcctgcaactacttcttcgcggagatgggataccgaatgggcatggacaccttccgggagtatctgcaggccttcggcctgggagagcacaccggcattgagattggtgattacgccggtaccttgcccagcaatgaggcgggccacgaccagaccccctgggccaccttcggccaggccaaccagctctactcacccctccagcttgccaactacatcgccacactggcctccggcggacagcactgcaaggcccacctgctgaaggccgtgaaatcctatgacaatacggaggtcctggctgtgggcgacacggcgcccaccaacgtggtctccatgcaggattccacgctagaggcggtgaaaaagggcatgctgggctacacccagcccggcggctctgtttacaatgccttccggaactgcgtggtcactgccggcgccaagaccggcacctccgagctgggcggcaaccagaccgaaaacggcgtcttcgtctgcttcgccccttatgacgatccggagatcgccgtggccatcgtcattgagcacgccacctggggctccaatctggccaccacgggcgtggatattctcaacgcttactttaccgccgacgagaccggcagtgccgtcaccggcgaaaaccaactgcttccgtaaggagacgcatccccatgagcgaaccctttgtctttgatccccgctgcgacctgtgcaaggagcccttcggcgccgtcccctgcggaacggcggtcacctttcactgccgccccctggccacggagggcttttcccactgcgcactggtcctctcctgtgagttttccgggacgcagcgggagcaggaactacccctggagggcttcgcaggcgagcggctttgcttttccggcacactgaccgcgccggagctgcccgatcttctctggtatcacttccgcttctggcgggaggacggcaccggctgtctgctggacaagaccggctaccgcagtgacggacaggccgtgtcctggcagctgacggtctaccaggaaagccgtacgcccggctggtttggggcaggtgtgacataccaaatttttccagatcgtttctgccgtctggtacccgtggaccctgcgggtctggttggccggcgctgggtccacgaggactgggatgacacgccggagtggcggccggatccggatggggagatccgcaaccgggacttctttggtggcactctggcggggatcacgtcgaaactggacgatttgaaggcccttggtgtcaccacgctgtacctctgccccattttcgagtccgcctccaaccaccgttataacacagcggactatacccgcatcgaccccatgctgggcacggaggccgatttccgcgctctctgcgcccaggcccgacagcgggggatgcgggtgattttggacggcgtgttcaaccacaccggatcccagagcatgtacttcaatgccgatggctattaccccactttgggcgcagcccagagccaggattctccctggtacagctggtaccggttccaccactggccggattcctacgactcttggtggggcatccgcactctgccagcggtggaggagtcctctccctcttatgtggatttcatcattgacggcaaggactccattatccgccggtggctgcgtgccggagcttccggctggcgactggatgtggcggatgagctgccggactggtttctggagaagatccgcgccgccatggaggagacggcccctgacagcgtcctgatcggcgaggtgtgggaggacggctccaataagatcgcctactcccagcggcggcggtatctgctgggcagtgagacccacgggctgatgaactaccccttccgcacggcgctgctggcctatgtctccggcggggatgccgatgactttcgggaggccatggagaccctgcgggagaactatcctccggcggccttttactccgccatgaactttttgggcacccacgataccccccgcatcctgacgctgctgggtgcggaccgaacgccggacaccaaggcggagcgggcctcctaccggcttttgccccgggagcgggcagcgggcatcgccaagctgcggctggcggcgctggtgctgttcaccttccccggctctcccatgatctattacggggatgaggccgggatggagggctttgaggaccctctgaatcggggaacctacccctggggccgggaagaccgggacctgctggcgtggttcacccggctgggtgccctgcggaatgcgtatccagccctgcagtccggcaccatctcctggctctacaccgcaggtcctttgttgatttttgcccggcagaacggtgaccagcggctgaccacagccgtcaacgcctcaccggactcccacactgtcacactgctgtgggaaggcgctggccccactgatctcctcaccggagatactcttccctgttccggcggtgttctgcacttgcagctgccgccctggggctgccgtcttttgctgtgaccggctgcggatgtttcacgtgaaacatccgcggctctttttctgccgtttgtttcacgtgaaacattttctcttccttttctctgcttttccgcttttctccttgcaacggccgtccacgcttgctataataaatgagcataagcatttctaccttattgggtattttcagaaagtaggtgcccacgtggcaaaaaccattgcgattgtgaatcaaaaaggcggcgtggggaaaacaaccacctgtgtgaatctcgccgcggccttgacggaggccgggcagcgcatcctcctgtgtgattttgatcctcaggccaattccacttctggaatgggcgtggacaagacggtctccaagggaatctacgatgccctgatcggcgaagtgccggtggaggacgccctggtgcacaccaaatacggcgatgttctcccctccaacaaggcgctggccggcgccgggatcgaactgatcggcatggagcgccgggaattccttctgcgggacgcgctggacaaggtaaaagatcgctacgacttcctgttcatcgactgccccccctctctggaactgctgacgctgaacgccctctgcgccgcggacgccatcctggtgccggtgcagggcgaatactacgctctggagggcctcagtgacctgatgaacacggtgcggatcgtccgcaggtccctgaatccccggctggaactggacggcgtgctgctgaccatgtttgacgggcggaccaatttggccttgcaggtggcggaggaagtgaagcactacttccccggcaaggtctatgccactgtgatcccccggaacgtgcgcctcagcgaggcgcccagccacggcaagcccatcaccgcctatgatcggacctcccggggcgcggaggcctacaccgcctttgcggcggagtttctgaaaaagcaaagcgcctgattctctggaaaggagcgttcccatggcatccaagaaaccctccggcctcggccggggtctcggcgccctgctgggcgacgacgtattgaaggcggagagcaccggcagcctgtacctgcccatttcccaggtggaaagctgttcctcccagccccgcaagcactttgacgaggcatccctggcagaactggccgactccatccgagagcacggtatcatccagcctcttaccgtccggaagctggcctccggctactatcagatcatcgccggagaacggcgctggcgggctgcgcggctggcgggccttcaggaagtgcccgtcattgtcatggaggccgatgaccgcaaggccgccgagctggccatgatcgaaaacctccagcgggaggatctgaaccccatagaggaagccgctggcttccagtccctgatggaaacgtatcacatgacccaggaggaggccgcgtcccgagtgggcaaatcccgcagcgccgtggccaacgcgctgcggctgctgtccctgacgccgccggtggccaagctggtggaggagggaaagctctccgccggtcacgctcgggcgctgctgcccctctcccccgccctgcaggaaaacgccgctggcgccgtgatctccggcggcctctctgtccgccagacggaggccctggccaagcggctgagtctggaaaagccggaaaaagcccccgcgccgaagggaatcgactatgccgcggaggcgcagaaggagttgagctccaagctgggccggggggtgcggatcgtcaccggccgcaaaaagggccggattgagctggaatactacggcattgacgacctcaacgacctgctggaggccctggcgatgctccgggcaaagcaaacgaaaaccccctgattgggaaaggatgatctgccatgaaatttgaaaaacgcagcggagacgaagcggagacaccctcctctgctccggaggaaacgccctccaccgggaaaaagcccgttgtcatctatatcatgatcctgttcatcgtggcctttctgctgatggcgctgtcctttctaatgcaccagcggagcaactccgaggtgattggggagcttcaggactccgtcactgccatgcaggaggtacaggccacgcaggacgccctgctggacctgcaaaaccagctggatgaagcccagaccaccatcgacgcgctggagtcctccgcagaggaaactgacgccgccttggcggaggcccagcgggagaaccaggcactgctggctctgtacaccattcagcagcagtattctgcgggagatctggcgggctgtcaagccagcatcgacgccttcgaggcgtctgaataccgggacgcactgcctgagactgctgaggagggtgtcacccctccctcccagcggtatgcgcagctgaaggaagcagcagaggcccgttgagcagtcaacggctggccattgtttcacgtgaaacatgcaacatcaataaattgaggagagaatcatcatgctggatatcaaatttatccgggagaatccggatgccgtccgtgaaaatatcaaaaagaagtttcaggatgccaagcttcccctggtagacgaagtcctggacctggactccaagcgccgggccgccattgcggaggcggatcagctccgctccaaccgaaacacactcagcaagcagatcggcatgctgatgggccaggccaaaaaggaccccgccaagctggcggaggccgaggctgtcaagcagcaggtgaaggaacaggcggaccgcttggcagagctggagaaacaggagacggagctggaggaaaagctccatcacaatatgctgctgatcccccagatgatcgattcctccgtgcccatcggcaaggatgacagcgaaaatgtagaggtccagcggttcggagcatgtgaagtccccgacttccccattccctaccacgtggatatcatggagtccttcaacggcatcgacctggatgccgccgggcgggtctccggcagcggcttttactacctgctgggcgacattgcccggctccatgaggcggtgctggcctacggccgggacttcatgatcgacaagggcttcacctactgcatcccccccttcatgatccacggcaacgtggtggagggcgttatgagccagacagacatggacggcatgatgtacaagatcgaaggggaggacctgtacctgatcggcaccagcgagcactccatgatcggccggttcattgaccagatcctgccggctgagagcctgccccagacccttacctcctactccccctgtttccgcaaggagaaaggtgcccacggcatcgaggagcgtggcatctaccgcatccaccagtttgaaaagcaggagatgatcgtagtctgtaagcccgaggagtccaaggactggtatgagaagctgtggcggatgtccgtggagctgttccgctctctggatattccggtgcggcagctggagtgctgctccggcgacctggcagatctaaaggtcaagtcctgcgatatcgaggcctggtctccccgccagcagaagttctttgaggtgtgctcctgctccaatctgggggacgcccaggcccgccgtctgcgcatccgctataaggatgaaaatggcaaaatgcagctgtgccacaccctgaataacacctgcgtggccccgccccggatgctgatcgccttcctggagaacaacctccaggccgacggcactgtccgcatcccccaggtcctgcggccctatatgggcggcaaggaattgctggtccccgcggaaaaatccaatttgtaattttttgttttatttatacaaatcgttgaacccgtttccagccgttggagcggcgcgcagccctgctccggatcattcggtgcccctccagcggctccattcgggtcaaatctctgaaagccttgggctccaatggttacagcatacgtacacaggcgcccattcatttcacacaggagagtcccatgactgaacttaccaaaaagaccaccggcttcctggcggagtttcgccaattcattgccagaggaaatgtgctggatatggcggtgggcgtcatcatcggcggcgccttcggcaaaatttccacctccctggtcaacgatatcctgatgcccctgctctccctgctcaccggcggcgcggacttctcccaatggcaatgggtcctgcgggaggcggtgtatgacgccggcggcagcgaagtgcgcgccgctgttgccatcaattacggctcttttctctccactattctggacttcctcatcatcgcctttgcggtcttctgcctcatcaaagctatcaaccgcttccaccgaaagaaggaggccgctcctcctcccccgccccagccctcgcaggaggaagtgctgctggcggagatccgagacctgctgaaggagaggacatgatggaacagcgcctgcaatcgggtcttgccgccctgaacctccctgtggagggaatccctgctctggtccggtatggggatctgctgatcgagaccaacaaggtgatgaacctcaccgccattacggacccggaggatgtggccactctccactttttggacagcgccgccctgctgaccctggagtccttttccggaaagtccgtggtggacgtcggcaccggtgccggttttcccggtctgcccctgcgggtgctggagccctccatccgcctgacgctgctggactccctgaacaagcgcatccagttcctggagacggtgtgccgggagctggacctccccgatgtggcctgcgtccacgcccgggcggaggaatttgccgcggagcaccgggaaacctttgatttagcggtctcccgggcagtggcggccctgccggtgctgtgtgagctgtgcctgccgcaggtaaagcccggcgggaagttcctggccatgaaatccgtggagtcagacgcggagctggccgcctcacagcacgccattgcgatcctgggcggcgccgtggaggcggtccgggactatgccatccccggtacagatgtgcgccaccggctgatcgtggtggaaaaagtgaaaaaaactccggaaaaatatccgagaatgtttgcaaaaatcaagaagaatcccttataatacatttgtgagcagttgaaaggaagtgccgcctgatgacgtctccaggacagtgcattgccgtcgcatccggaaagggcggcaccggaaagacctcctttacggcgggtgtaggcgcggctctcgccctatctggccggcgggtgctgtgcctggactgcgacatcggtctgcggaatctggatctggccctgggcctgtcggaccggacgctgatggacttctcagacgtggcgcagaaccgctgttccctggaactggccgctgtggaacaccccaagatccccggccttttcctgctgaccgcgccggcgcgtccccatggtcgcccggtgacggagatccagatggcagatctgctgcgggaggtacgcaggcggtttgacttctgtctgctggacgcacctgcgggcctggggcggggctttcagctggccacctgcgccgcggaccgctgcgtggtggtgaccactgcggacgcctcctccctgcgggacgcccagcacaccgtcatggagctggatcgcttcccatcaggcgccctgcacctggtggtgaatcgggtgcgcaaaaagctgctgcgccagctccacgccaccattgacgatgccatcgacaaggccggcctgccgctgctgggagtggtccccgaggatgacgccctgccgctgtgtatgaaccggggtgtgcccatcctgctggcggacggccagagcgccgcgactgcctaccgcaacattgcgaaacgcctccagggggaacgggtccccctgctgcggatcagatagagaaaggagtctttcatgaacatcgccctcatgtcccacgacaacaagaaggagctgatggtgcagttctgcaccgcctacgccggcatcctgtcccaccacaacatttacgccaccaacaccactggccacatggtggccgacgccacgggcctgaatgtccactgcttcctgtcctacgcccacggcggcagccagcagatcggcgcccggatcgcatacaacgaattcgacctggtactcttcttcaacgaccccaacaacgaggctatggtgggagatgtttcctatatctcccggctgtgcgaccagaacaacatcccctttgccagcaatctggccacggcggaggcgctggtactgggtctggcccggggcgatttggactggcgctgcatcgtcaatccctccaaccgtcccatcgcttgacatttttccccaaagcgcatacaatcaccctgttgattcatttgcaccgcgcggatgccgcagcagtactccaatcgccggccccacagagaggggcgcaccgctgagagcggcccggccggcctggacgaaggacagcggcggagcgggggcggagacgcccacggcaccctccccgtagcacaggaggcaaaaaggaggctctataggccttgaatttgggtggcaccacgaagcggaatcgctctcgtcccaaagccgcgggacgggagcgttttatcattttgcgcccgcggtgcatcccgggcagcgacccgcatcccacgaaaaaggagttttgacgatggctaaaatgaccccacggacactgtccggctttatggaactgctgcccggaccacagcagcagatggagcggatcatggagatcctccgccgtacctattccctctatggctttacccccctggacaccccggtgatcgagtccagcgaggtactgctggccaagggcggcggcgagacggagaagcagatctaccgcttccagaagggcgacgcggatctggcactccggttcgacctgacggtccccctggcaaagtatgtggccctccactacaacgacctgaccttccctttccgccggtatcagatcggcaaggtgtaccggggtgagcgggcccaacggggccgcttccgggagttctatcaggcggacatcgacatcatcggagatggcaggctctccatcatcaatgaggcggagatccccgccatcatctacaagaccttctccaccctgggactgaagcggttccagatccgggtgaacaaccggaagatcctcaacggcttctacgccatgctgggtctgacggagaagtccggtgacatcatgcgcaccgtagacaagctggacaagatcgggccggagaaggtgaaggccatcctcaccggcgacctcgccgtgactccgtccgacgccgacgagatcctgaagtttatcgccatctccggcggaaacgacgccgttctctccgctttggagggctaccggggccggaacgaaatcttcgaccagggtcttgaggaactgaacacggtggtccggtatctggcggacttcggcgtcccggcggagaatttcgccgtggacctgaccatcgcccggggcctggactactacaccggcaccgtctacgagaccaccttgctggatcaccccgagatcggctccgtctgttccggcggccggtacgacaatctggcggagtattacacggaccgccagcttcccggcgcgggcatctccatcggcctgacccggctgttctatgtgctgggagaacagggtatgctgaatccggacctgcccaccgctccggcggatgtgctgatcctgcccatgacggaggacctgtccgctgccatctccctggccaccctgctgcgggaaaacggcatccgctcccagctccactgcgaggaaaagaaattcaagcagaaaatcgcctatgccgacaagctgggcatcccctatgtgatctttctgggggaggacgagatcagctccggcgtggtggcctgcaaggacatggccaccggcgagcagacaaagctggaacccgccgccaccgtctaccgcattaaggcgggtctcgcggaacgggaaaagggcaccgtcatccaggagtaattccctgccccacagagatactttaacgccgaatttcacctgcggagacaaccaaatcgcatctcaagcagtccaagcagaaatattttctataaaaaatacaagcagtatttactagaggtgtttctatgaagaaccggaagcgtgtctgggtgcctttgttggtcctgctgctggtcgccgcgatctggtacagccgtccggtaacattgccggacctgatgaagggccaggaactccaagagatcaacgtcctgatccgctccctgggggactgggcccaggagccagagaccgccacggtgtcggtacccctcacttccccagagggggcggccctgctgaaacagctccaagacctctccttctgccgttctctgacagacccgctaatcaagccccttgctcaggcggtgaatgccagccatgggtccgtcttctatgaggcgggagactggatgttctccctctccctcgccggtacagatggcgattttgctgtgctgaactttaccgtccgggagtggtcctatgctgctccgggacaggcggacttctacggctgcaccgtcccggacggagaggccgttggcaggggccttggggaacagctctgggctctggcagcgaaatatgatctcaattcgtaatattttttatataaatttctatttgtaatcacatttccacacagaaaggaatccacaatcatgacacagaatcgcacccatacctgcggagagctgcggctctccgacgccggcaaggccataaagatctgcggctggctggaaaacctccgggaggtaggcagtgagctggccttcgccgtggtccgggacttctacggcaccactcaggtggtggcggagaccgccgacatggtggccctgctgaagtccatcaacaaggagtccaccatctccgtggagggcaccgtccgagagcgggacagcaagaacgccaagctgcccaccggcgagatcgaggtggtacccggcaaaattgaggtgctgggccgctgccagcacaacgagctgcccttccccatcaaccgcagccgggaggccgacgaggccacccgcctgaagtaccgctatctggacctgcggaacccggcggtgaagaacaacatcatcctccggtgccaggtagtggccgccctgcggcaggccatgacagagcatggcttcctggagatcaccacccccatcctgaccgcctcctccccggagggtgcccgggactatctggtgcccgcccggaaccaccccggaaagttctatgccctgcctcaggcgccccagcagttcaagcagctgctgatgacctccggctttgaccggtacttccagatcgccccctgcttccgggacgaggacgcccgggcggaccgctcccccggtgagttttaccagctggacatggagatggcttttgcctctcaggatgacgtatttgccgtactggaggacgtgctgccccccatctttgccaagtacggcaaatacgaccgggccagctccgcgcccttcatgcgtatcccttacaccgaggccatggagaagtatggctccgacaagccggacctgcgcatcgacctgacggtgcaggacgtcaccggcctgctgggcgcctgcggcttcggccccttcgagggcaacgtggtgaaggccgtggtggtcagcgacttccacgagacccggaaattcatcgacaagaccctggcggatgtggaggtggtctccggcggcaagccctactggttccgcctggacgaaaacggcgaaatcgtgggcggcatcgccaagtttgtccagcccatcaaggagtctgtggtctctgccctgggtctgaagcccaacgacttcgtggccctgtccgccggcaagctgggcgctgcccaaaagaccgccggcacgctggtaaagactctgggcgccgccgtccccggtcacatggacaaggagcagtacgccttctgctggattgtggacttccccatgtacgagatcggcgaggaatccggcgagctggagttctgccacaaccccttctccatgccctccggcgggctggaggtcctgctgaaggcggagcggggcgagatcgatcccctcagcatcaccgccgaccagtatgacctggtgtgcaacggcgtggagctcagctccggcgcggtccggaatcacgacccggagatcatgattaaggcctttgagatggtccggctgggcgaggaggacgtaaaggccaagttccccgccatgtacaacgccttcacctacggcgcgccgccccatgcgggcattgcccccggcgtggatcgcatggtgatgctgctggccggggaggactccattcgggagatcatccccttccccatgaacaaaaacgcccaggacgtgatgatgagcgcccccagcgaggtcacgcagaaacaattggacgagctgcacatcgccatcgtcaagccccaggactgacctgtaaatccggaataaaaaagagacggaccgcatttctgcgttccgcctctttttttccactttccggcatcatcccacgcataccaccttcatgactccggaggtcaaagcctgtcaaaccgctggccctgggtattgcaccagaaatggtcctccgccagaccggagacgtaataggtcagcggcccggagaaatcgccggattcgtggatatctatctccaacgacggacaccagcccatgccgccgcggtcccgcagccgggcagaaaaggccgtttccccatagtagtccaggtaggggattaccacccgacaggtgccgctctggaagatcagcagctcctgcaaggtgctgtcacaccagatgccgtcaaacgcagccaaatccgcaggccaggcagagggctcctcctgccagagcgtggtctccgtccccagaagcctggtgaaaaagggggacagggaccggaccgccgcccggtaggtctcttctcccagctccggcgcctcacctgctttccgcaggctgtccgccctgtccagaaccgctgcaaatgccactgcggaggctgccggttccgcctccatctcctccaaaagggccaggaccacgtcctcctccgggatcgtctgtccagagcccgcccagtccagcagggtccgtgccgccgtctccggtgtctcctccagcacttgtacagccaccatctcccaggtggtctccgagaccgtcccctccccctggggactccccagcagggcgatcattgccatcagtagagccgccatccgcatgttgtcacacgctcccttctatttttgccagcataccacggggtccgtttggattccaccacaaatcagtaacagtcttttctttcgggcctggatgtgatacacttcatatcatcactccacagcagaaaggagctcttatgaaacgactttttacaattctgctggctgtcctctccctgttgagcctgactgcctgcggcggctcccccacagaggagacttcccaggaacccttagtggacattcagccccaggagccggaggcgcccccggaacccacgccggaggaactggccgcccaggaggtggaggacctgcttgcctccctgaccctggaggaaaaggtcggccagctgttctttgtccgggtacccgacacagacgcggtctccgacgtgagcacctatcatctgggcggctacatcctcttcggccgggatacggcggacaaaactgccgatgctttgatccagaccattcagagctatcaggacgccgcggctgtggacaccggaatcccgctgctgatcggcgtggacgaggagggcggcacggtggtgcgggtcagctccaatccccatctgcgggcctccaagttcccctctcctcagaaagcttatgcctccggcggcatggaggccgtgctggcagatacccgagagaaggacctccttctctccgccctgggcttcaacgtgaacctgtccccggtggcagatgtgtccaccaaccccgccgactttatgtatgaccgcaccttcggccaggatgcggccgccacagcggactatgtggcccaggtggtctcgcagatggcggaggacggtatgggcagcgtcctcaagcacttccccggctatgggaacaatgtggatacccacaccggtatcgccgtggaccagcggccgctggagtccttcacgtcctccgacttcctccccttccaggcgggtatggagagcggcggcggaaagaccgctgtgctggtctcccacaatatcatgactgctgtggatggagatctccccgcctccctgtccccgaaggtccacggcctgctgcggacggacctgggctttgacggcgtggtgatgaccgatgatctggccatggaggcagttgcagcgtacagcgccgacggggccgtggcggtgatggccctggaggcgggaaacgatctcgtcatcaccaccgactaccgcacccagatccccaaggtcctggaggcgctggaaagcggcgccctgtccgaggagaccatcgacaccgcctgccgccgggtgctgacctggaagcagaatctggggctgctgtaacatacctcccggtcccatcccctgacgaaaggaagttttccacatggaaacggaaaaactctattaccaagatccctacctcaccgccttcaccgcccgggtgctctcctgtgaaaaatccaaatctggctgggccgtagtgctggaccgcaccgccttctacccggaggggggcggacagccggcggaccacggcactctgggcgcagtccaggtcacggatgtccatgaaacaaagggcgtgattttccacacctgtgacggccctgtggagatcggcacccaagtggcggggccgttgactggccccgccggttcgaccacatgcagcagcactccggggagcacattctctccggcctgctgtgctcgctgtaccactgtgacaacgtgggtttccacctgggggccgacacggtgaccatcgactacaatgccgagctgacctgggaacaggtcatggccgcggaaaaggccgccaatgaggtgatctggcaggacactccggtggacatcaccttccccgcgccggatgcgctggcccgtctgaactaccgcagcaagaaagcgcttaccggccaggtgcggatcgtggccttccccggggcggactgctgcgcctgctgcggcacccacgtgcgccgggccggtgaggtggggattatcaagatcctctcctgccaaaagtttcgggagggggtgcggctggagattctctgcggatcgcgggcctaccggtatctctcccaggtatacgaccaggaccgcgccgtggcccagctgctgtctgtaaaaccccaggacaccctggccgccgcagagcggcaggcggaggagctggccgccgccaagcagcggatgacggagctggaggatcagctcttctccctccgggcccaggccctgacagaccggggagatctgctgcttttggagccccccacgcggccggacggagccagaaagctggcagacgcagccgcaaaggcctccggcggtctggcggcggtgttcgcgggagcggagtcctcctacgtctatgcccttgtccaggccgatggggcggacatctctcccctggtgaagcggctgaacgccgctctttccggccggggtggcgggcggaacggctttgcccaaggcagcgtgcaggcggaccggaccgccatctgtgactttttccgcaaggaggggattgaatgtcctacgtgctgatcgaacagaatcttgaggaagaggacgagccccggttcatctacgcggaactggacagcgggcgccgggaggtccggcgggtggaattctaccccaatggcctctgctttgcctacggcggcgactacggccgggaggaggctctctcccctgccccctacccggaggacctgcggacgctgaaccgccccggggaggtcaccgcccgcgccatcactccggccgcgttttgggagatctggggacaggcccaggagcggccggacggctttatggggatgtttgcctgatgagaagaagcatttgttttgccgggggctgcttctggggcatggaggccctgtatcgccgcctgcccggcgtactggatgtcaccgccggctatgccaacggagacacggcagatcacgccaactatgacgatgtctgcaccggccgcaccggcttccgggaggcggtgcaagtggcgtatgaagacgggactgtctccctgccccacctgctctttgtcttttttgccgccatcgacccggagactcccaaccgtcagggaccggacgtgggcagccagtaccagaccggcgtatactggatggacccggcggacgagggcatcatccgctccatcgctgtcctggaggccgcggccgttcccttcttcgccgtggagctgaaggccctggcgtgtttctatccagcggaagaattccatcagcggtatctggaaaagcacccacggggctactgccacgtggccccctggaaactggccgccctgccggacttccccttttccacaaagacctatacccgtcccgcaaaagagctgctgcagacctggaaagaagccggagaagtgtctttctgacgggcgggggaaactctgttttccacaggctgaccatatttgtgtaaataaaagcgccgcaggcggatgcctgcggcgctctctttgattcagcttccgtcactggacgggctcgttcatctctgcagtgatatactgttggccgtacatggcgtcgtacagcacatcctcccgcagctgcagcagctcccgggcctcgtcggagagagccgcctcctccacgccggcgctgggcgtccccgtgccatccacaaagtacagctccgtgttggtgagacacacctggctcaccttctccagcagcgcccagtaccgggtgaccggctgaccggtcagctccagcagctgggggccgatggcggtgatgctgctatcccgccgggtgcctgcctgcccctggagcaaggccgcatcattggcccagatcagatagtccgtggaatacaggtcgctgatctcctccggggtccagcccaccgtgtcgttatccgggcagaggcccaactttgtgtacactgtgtccccgtccgtcatgaacagattgggcctgtgatccccgaagaacaccacgatggtaggctcctcgctctcccacagggcgtctgtcagatctcccagggcctgatccgcccgggtgatgccctccagcatgacccggacgatggccatatcctcctcgccgaggctttcgctggtgacgccgatctgacactcatagttgaatttctccgggtcaaagggctggtggttctccatggtgatgccgtagagaaacgcccgctccccgctgctgttgatgtcctccatccggtccagcatggcctggaagaagtaactgtcccgcatgtaatacccgccgtagatgcccccctcccagggaaagtccagagcctggatatctgcggagaacagaaggtcggaaaagcccagcctgggataggtcaccgttcgattatacaggctgtcgttatacccatggagcatctccgcccggtagccgctcttggtatactgctccggcagggcgtcaaatttctcataggcgtcatcctccaggaagcagatgttcgtcccagcaccgaagtccagctccgtaatgccgtacagcatggacatctccagatagccggtgccgtagcccagatagtggctgtggaatgtgccgctgatgccctcgctctccagggcatggaagttctccaggggatcccgttcatactgaaggcccggcagccgggtcagatcgtagaaggactccgactgggccacgatgatgttgggctgcaccgccgctgcgggggcgtcggcgctgtcctctgtcaggatctcgtcgatccgggccaggacctgctccatgtaggcttcgctgtatccctccgggctcttcttggcctgaagaaagcagtcccgccagagactcagcgtcaaaccgtaggtgtcgtggctgttggccgcagccaggcgggtgttcacatccacctgaaaaaccgcccccgccgcctgggctccctgtgtggaaaacagcccaatggtcagggccagggaaacggaaaaagtgacaaagcggcaccgcccggtgagcagcgtcagccgccgcaccagaatcagaatccccacacacatccccagggcgatcatcgccatccagaaatccaccggcgggcgcagctctcccgccacaccggccacctctcccacctgtgccgccaggccgaagtccgccagcaccagtggcgtgccgttgatagctgtcttgaaatagtccaccagggacagcaccagtccggcaacccccaccagtatagcggaaagccacaatctacccagcagcgcccccagggtgaacaccacagcgccgtaaaggacgccggtcagcagcagataggtgggccatttcacgaaccactcccacacgatggagagggaaccggtaaccacccactggacggccaccgccacagccagccccatgcaaaggctgccgcccagaaacatgacccagcgcagccacaccggccccaacgcccggggccgcttctgtctcttcaacacttctacctcatttcccaggttataaaaagggtcgcggggatttcccgcggccccgataatctccgatcagtatgccagtttctccgccagatagctcttcagctggtcgacgggcagccgcacctgccctcccgcaaaagcactgcttttgcgggacccctgtcccatctcattcctcgggcggaatgaatccgccctccggcgagattttgcctccggcaaaatgctcggacgccgcgccgcggcgttctggagcaggatcgacacaggcatcagtatgccagtttctccgccagatagctcttcagctggtcgacgggcagccgcacctgccctcccgcaaaagcactgcttttgcgggacccctgtcccatctcattcctcggacggaatgaatccgccctccggcgagattttgcctccggcaaaatgctcggacgccgcgccgcggcgttctggagcaggatcgacacaggcatcaatatgccagtttctccgccagatagctcttcagctggtcgataggcagccgcacctgccctcccgcaaaagcactgcttttgcgggacccctgtcccatctcattcctcgggcggaatgaatccgccctccggcgagattttgcctccggcaaaatgctcggacgccgcgccgcggcgttctggagcaggatcgacacaggcatcaatatgccagtttctccgccagatagctcttcagctggtcgataggcagccgcacctgctccatggtgtcccggtcccggacggtaacgcagttgtcaccagccttatccgcatcgcccacggtgtcgaagtccaccgtgatgcagtagggcgtgccgatctcgtcctcccggcggtaccgcttgccgatggaaccggtgtcgtcaaagtccaccatccagtccttgctgagctccgcctggatctcacgggccttttcggagagcttcttagaaaggggcagcaccgcgcacttaaaaggcgcgatggccggatggaaccgcatgacggtgcggacgtcgttcttttctgcatccaccacctcttcatcgtaggcttccaccagcagggccagggtcatccggtccgcgcccagggagggctccaccacataggggatatagtgctcgttcttctcctgatcgaaataggtcagatcctggccggagtgctcctgatgctgggtcaggtcgtagttggtccggtccgccacaccccacagttccccccagccgaaggggaacagatactcaaagtccgtagtggccttggagtagaaactcagctcctcgggctcgtgatcccgcagccgcagattctcctccttgatgttcaggcccttcagccagtcgtggcagtacgtccgccaatactggaaccactccagatccgtgtccggcttacagaagaactccagctccatctgctcgaactcccggatgcggaaaatgaagttacccggggtgatctcgttgcggaaggacttgccgatctggcacacgccgaagggcaacttccggcgggtggtccgctggatggcgggaaagttgacaaaaatgccctgggcggtctccggccgcaggtacacctcgttggcggtgtcctccgtgacgccctggtgggtcttgaacatcaggttgaacttgcggatgtcggtgaagtcgctcttgccgcagccagggcagggcacctggttgtcccggatgaatgccaccagctcctcctgggtcatggcctccacgttcacgtccatgccgtgctcctgcacatagctctccaccagcttgtccgcccggtggcgcatcttgcaggccttgcagtcaatcagaggatcgttgaaggtggatacgtggccgctggccacccacacctggggattcatcaaaatggcggagtccagtcccacgttgtagggattctcctggacgaatttcttccaccaggcccgcttgacattgttcttcatctccacgcccaggggaccgtagtcccagctgttggcaaggccgccatagatctcactgccggggaatacgaatccccggttcttacacagggccacgatcttctccatggtcttctcggtgtttttcatgttccattctcctttacggcggcccggacagaaaaaacgccccgagccggttttcggctcagggcgaacaatcagtccgtggttccacctgaattcgcgcctggctgacgcgcactcttcacccggtaacggcggggaccggcagggcatttccgccccgcggctccagggtgcctgttcttccgcctccccgcaagggctcacaccagccgccctctctctttgccggggtatgggggatacttctccctgtcactgccttttggatatcgtgagaactgtatcacgttttcatcagaatgtcaaggccgagtcccacagaagccgcaccaggcagggcactctctcacccggaccctggtctgatcccttatccgaagcgcagaaaaaggccgccccatagggcggcctttcccaatttactttttctcccgatcgtaggccacgatcacccggcggttgggctccgttccggtggagtaggtcgtcacattgggcacatcctgcagcgccgtatggatcacatgccgctcataggcattcataggttccagtgtcacgctgcggcggtacttggtgaccttggcggccaccttccgggccagatgctgaagactctgctcccgcttttcccggtaattctccgcgtccagctgcaccctcacccggccgctgccgctgcggttcaccgcatagctggtcagctgctggatggcgtccagagtctcgccccggcggccgatcagtgcgcccagattcttgccctccaggatcaccttgtagcggcccttctccagcagatagatgtggatctccgcagcactctccatctgctccagcaggccggagaggaacttacggatggcctgggccttctcgtcatccacttcttcgcccagtgtctgcacgggagcggactgccgggtcttctcctccggggcgggcgccggcgcctccgccggcttgcgctcctgtctgggcggcttttccgctttggggggcttaggccgctcttcctgcggcttctccttgggggcaggagcgggggcgagaacctcctcttcctcctccgggccgtagctcacccggaccttggccgggctgctgcccagacccagaaaaccggactttgctcgctccaaaatctcaacggacacatcgtcccggtccaggccaagctgccgcagggcattctggatggcctcatcctcggtcttgcccgttacatcaataaactgtctcatggcgtaacaagctccttactgatcatcatagcggtcctccttgtaggaccggccgcgggcatagggccggtctcccacacggcccgcttccgtggtgctggtggccgcctttttggccttcagggccttggcctcctgcgccgcctgccgcttttccttcaggctcttcttctgtgcggcctgctgacgctgctgctcctgaagcagcttggcctcctccatccgcttctggcggtccgcctggatcatctcctgccgggcgtcctcctcttcctgcagcttcttggtgtagaacttgcccaggaccatctcctggataatggaaaacgcgctctgggcagcccaatacacgcccagggcggcgggcacgatgaaggcgatgtagatagacatcagaggcatcatccacatcatcatcttggtggagccgttggcagccgcagtctgggcggactggctcatgctgaccttgctcagcaggaagctgaacacaccggaaatgatgggaatcagaatcagtcccaccgcggccagcgtgatgcccgtggagaggctgctgacagcgctccagggcgtctggatcaggtcaatccccaggaagtggtagtcgatgttcacccagccgggatgctctgcaatgaagtcggggaactggctgttaatgatgttggaaatggcgatctgctcatagccggggctggccacgatctcaatgccggcgccttcaatcagacttctggccgcattcactaccgccagaccggcgtccttgccgccgaagttcatgaagtagacaatgggctcccggatgatatagtacagggccatcagaatgggcaggggcagaaagctccacaggcagccgctcatgggattgaagccctcttcctggtagaacttctgcatctcctcctgcatcttcagctggttgttggcgtatttcttctggatctcctgcatcttgccggacatgcggctcatccgcaccatgctcttcttggacttcatctggaagggcagcaggatcagcttgatgaccagcgtgaacaggatcagggacacgccgtaggaccctgtcaggttgtaaaacagccgcagcagggccgcaaacgggatacaaattgcgtatccgatggttgaaaacatagatgcttcctccaaattgtaatgggacccgggctttcagcgcccgcagagcggagcatttccgctttcggcctgtccgcattccgcagtaccggctgacagacggccggacagcagcacagggtccggcagaggggcttgtcccctcctctcatgggaccggatcatatcctcccttgtgaaacggattacagcgcaggatacgccggaacgccagccagccgcccttgagggcgccgtacttctcaatcgcctccagcgcatattgggaacaggtgggaatataccggcagcaaggcggccggtacggggagatggccacccggtaaaatttcaccagggccagcaggacctttttcatcatgaccggtcctccagcagctccagcttcctgcaaagacgcaggaaggtatcgttcagctccttccaggaggcagtcagggtccgtcccctggctaccagaatcatgtcgtacccctggcggagccgtccggaattgagccggtagacctcccgcaggcggcggcgggcccggttgcggaccaccgcatgacccagcttgacggataccgtcacgcccaggcggttgtgccccagccggtttttccggcagtaaagcaccatccctccgcccacggcggaggcgcccttctggtacagccggcggaactcataattctctttcagggtcactgcccgcttcatgctgccacctgccttctcccatttgatacatctgacacaaactcaacgagggacggaggaatcacagaattcccgccgtccctgaagacgttgttcaagtgtctcccgcacggtccgtttctcagtaggacagacgggcgcggcccttggcgcggcgacgggccaggaccttgcggccgttggcggttgccattctcttgcggaaaccgtggaccttctggccgtgcagcttcttgggctgataggtacgtttcgttgccatgttgagacacctcctgtcagaattgcggcccttttgagggcggcacttactcgacaccgcctaaagggcggcgcagtaaacagatcaagaccgcatgatcgcggcgcaaccgatattatacagactgtttgaaaatatgtcaactaaaacttaaaagttttgcgaaatttccgtatttttttcttttttcagttgcgattctcgaaaatttcaaaatctggtgtcccatgctgtccaaagccgctatatcttgttgcctgtgcaggcggatctccttggttcttattattagaataagtgttgtaatttccggctgtctttggtataataaagcgtactgccatgtctattttttactagagagaggtgtttccttttgaattccgtcgccgacgtgtgggacaatgtactatcccagctgaagggcgagctctcggagaccaccatcgccacctggttcgacgaattggaggctgtggacatccagggcaatacgtttatcctccactgttccaacgactttaaaaaaggctatatcgagtccctgttcatgaaaaacatcaaggcctcccttcacgacattttctccacggattttgaagtgaagattctggatgacctggattacgcagagctcaaggataaccgcccgcaccgccagagtgagcggttcacttccgcggagttcacattcgagaccttcgtggtgggcccttccaacaagctggcttatgccgcctccgtctccgtggcggagcatcctgctcagaactacaaccccctgctgatctacggggactccggcctgggcaagacccatctgatctatgccatcgccaacgtcatccgccggaacgacccccggtccaagatcgcttacgtcaagggcgacgacctgaccaacgagctggtggatgctatccgggagggtaagactgcggagatgcgggagaagtaccgtcaggcggacctgctgctggtggacgacgtgcagttcatcgccggcaaaaagcagacgcaggaggagttcttccacaccttcaacaccctgtacgagtccggccggcagatcgtcctgacctccgaccgccccccctctgagatgacccagctggaggaccgcctccgcacccgatttgagtggggactgctggtggacgtagcgccgccggattttgagacgcgtcttgccatcgtgaaaaacaaggccgccctgctgggcatggagctgccggacaaaatctccgcctacatcgccgaaaacgtcaccgccaacgtccgccagctggagggcaccatcaacaagatcctggcctacaaggatctgctgggcaacgacaccgacgaagaaaccgtcacccgggccatccaggacatgctgcgccgcagcaacgagtatgtccccacgccggaggccatccttgagtatatctccaaatattacagtctggacgagtccgtgatccggggccagcagcgggtgcgggacgcggtctccgcccggcagattgccatgtacctgatccgctccatgacgaacctcagtctggatgagatcggcaaggtctttgacaaccgggaccactccaccgtcctctactccatccagcaaatcgaaaagaagatgaagaaggacgctgcgtttgccgaaatggtgaaggagatcaagacgaatatcaactccaagcggtgaccagatttctccacatcttccgtggaaaagaaaaacttccctgttgaaaatggtctttcaaaaaagtccgtggaaaaatccccggatccttccacatcccctgtggagcctcaaaatccgacagcgcaagcctttccccgccttttccacagcttttttccctacggctgctttttctaaaaaatacatttctttctttttcaaaagagcgattccgacccatatcttcaaaccccgactagagaggaagtgcatgcatgaaattctcctgtgaaaaagcccttctgcaaagcgccatcgccgtcaccagccgcgccgtggcccagaagagctccattcccgcgctggaagggctgctgctccacgcggacagccagctgaccatttccggctacaacctgcagaccggcatccgtacgaaggtctccgccgatgtaacggaacctggcgagattgttttaaacgcccgcctcttcggcgacatcatccgccggatgcccgacgatgtggtggttttcaccgcggatgacaaacagctggttcatctctcctgcggcgatgcggactttgatatcctgggcctctccgcggcggattacccggagctgcccatggtggaggatgatttttccgtctccatccaacagaagctgctgcgtgccatgatcgaggagacggccttcgctgtctccaccaatgagagccgccccatccataccggtgccctgttcgagatcacggaccagggcctgactatggtggcggtggacggattccgtctggccatccggcgggagccgctggaaaagatcgacggcggcgccttttcctttgtggcgccgggcagcgccctgggcgaggtgaaaaatatctgttccgacgtggaggatctggctgccgtgaccctgggcaaaagtcatattctatttgaggtaggagacacggagttgatctgccgccggttggagggagagttcctggattataagaatgccatcccacggaagaatcccatctccgtcatcgcggacaccaaggccctgatcgagagcattgaccgcgtcagtgtggtgatctccgaaaagcagaagagtccggtccggtgcctgtttgaccacgacaaggtgctgctctccgccaagaccggaaacggcgaggccaaggatatctgccgcttgtccggtgacggcggcgggctggagatcgggttcaacaaccgctatctgatggaggctctccggtacgcgccggcggacacggtgaagatcgagctgaataccggcgtctcccccgccatcatcgtccccacggagggggaggaaaacttcctctatatggtcctgccggtgcggctgaagagcgcggagtgagcagatggagacgatcacgattcacacggagttcatcaagctccaggacctgctgaaattcgccaatctggtgtcctccggcggcgaggcaaaggagcggatccagggcggcgaggtcaccgtcaacggcgagatctgcaccatgcggggcaaaaagatccgccccggagacgatgtggccttccagggcgcccattacacggtggcctatgcggattcttgagctggagctgcagcatttccgcaactactccggccagcgggtatcctttgacccggactgcaatgtgatctttggggagaacgcccagggcaagaccaatctgctggaggccatcgtctacctctcctgcgggaaatcccccgggccaggacggaccgggagatgattgccttcgatgcgcccgccgctgtgctggaagccgggatctccgcccgagaccgggagttccgcacccgggtggagctgtaccgggaccggcggcggaagatgtgggtgaatcaggtgcctgccaaaaacagcgccgccctgagtcaggtgtaccacaccgtattcttctgcccggatgacctgtatctgatccgggagggggccgccgcccggcggcgcttcatggacaccgcactctgccagttgcggccgagatacgcggccgctctggcggagtaccaccggctctatgaccacaagacccgcattctgcgggacagtgaggagcggccggatctcctggagctgctgccggacttcaacgagcggatggttcgtttcggcgctgtgctggtccactaccgccggcagttcgcggaggcgctgaaccgctatgccgcccgccaccatcgggagtgctccggcggaagggagcgcctggaggtcacctatcagactgtttcctccgtcacggacccggcggcggaggtggaggtcctcacggagcagctccgggcccacatggaatcccaccagggggcggagcgggcctcccggatgtgcctctccggcccccacaaggacgatctggtcatcaccatcgacggccgggaggccaaatcctactcttcccagggtcagacccgcaccgcggctctggcgctgaagctggcggagcgggaaatctaccagaacgccaccggcgaatacccggtgctgctgctggatgacgttctcagtgagctggatccccgccggcaggagttcgttctcaaccgcatcgcgggggacaggtgttcatcacctgctgtgaggatgaccggctgccccaaatgctgggcgggaaggtgttccatgtgaaacagggcgccatcagtggatgatccctgcggccaggcggtagcctgttcaatcaaacacaacagatccaattacaggcccccaacatgacaaaatggaggtaaccgtgatgaattagtacgcagtgcttcccattctggttttcggcggaccagctgctggctttctctgggagctgatcgtgggattggtctgccggacaaggcgctatctgctgtgggtgcctgttctagcgggggcgctgggactggcgctgtgtgtggtgtctcctttccataccctcccgttctccttcctactgctgtgctgggggctgtacggtggcggacttctgtttggatggagtctgtccaacctgctccgtggcggggaggaccactttcagcggtatgccgtccgtgccgttgccctctgctccggtgcggcgctggccatcggcttcggtgttctgatctcccacgagatgcgcagcgccacctataccatggtggaagaagacaccagcgaggagcgcgttctggcagagatcccggagctggccattacagagacggaccgggaaatcctctccgccctggaggagagtccctccgtccaggcggccgtcgccggaggggaacagttcatcgatctgccaccgtcagaacacgaggacatccacgcgatcctgtcggaatttctggatgaagagcgctaccagttttccgacgcgggcgtcaccgcccagtccggggaggtcacctccctgtattacgatattttcgatcaggagaggaatgttcggatcatcgtcatgggcctggacaccggaaatcttaacaaggtgatcactgtctacgatggagatccggaagaggaattgtccatggtgatctatgaaaatgacaacggcgccctccgcaaaatgaagaagcagcggatgtggttttatgacttctatgaaacagagttagaatgaggcacggatcgctccctctacaagggcagttccgcatccgtaagcggcaaagtcgccaacagataccgaaaggagaccaccatgtacctccacatcggccaaaacgaaattcttcccgaccgccgggtcatcggcatctttgatctggacaaatgcagttacggcaagcggacccgggagtatctggcggccgcggagaaagagggcgtggtgctggacgtgtccggcgagatccccaagtccttcgtggtgtgcgatcacccctatcaccggcagatcgtgtacctcagccagctgaattccaccaccctccagaagcgggcggagagcggaaacctggaatgagccagggggagatcccatggcggcatatacgacactggtaaaccttccccactttttatcctcgttcacatccctggagacaggaactctggtgctctttctggcggcagtgttcacggtgcagctggtcctgctgcaaaattacagcaggcgccggagacggctggtccagcccgctgcttctggtgtacagtgcgttccttctgctgctgtattttgcctggatggcgctgttcaccgccctcctggctctgctgacatatctgattttgaagaaattacgcacttgattccaacttacatggttcagggcaaggagaaacgggccggaggcggctccggcccggctcttcttgccttggaacggatatgaatatcctgaaaggagaacctgcatggcagaaaatgaactgttgaactccactgcggtggacacggccaacgagtacgacgcatcggaaattcaggtgctggaaggcctggaagccgtccggaagcggcccggcatgtatatcggctccacgtccacctccggcctgcaccatctggtctatgagatcgtggacaacgccatcgacgaggcactggccggctactgcaccgacatcctggtgcgaatcaacgagggggacaccatcaccgtggtggacaatggccgtggcatccccgtggacatccaggcccagaccggcaagcccgccctggaggtagtgtacaccgtcctccacgccggcggcaagttcggcggtgggggctacaaggtctccggcggtctccacggcgtgggcgccagtgtggtgaacgccctttccgaatggctgacggtccaggtccaccgggacggacatatctatgagatgaagttctccaggggcaatgtgacccagcccatgaccattgtgggagatacagaccacaccggcaccactgtcaccttcaagccggacccggagatgttcgaggatacggagtacaattacgataccctccacacccggatgcgggaggaggcgttcctgaacgctggcctgcgcatccgcactgtggacgcccgccccggacgggagcaggaggacaacatgtgcttcgagggcggcatccgggagtttgttacctggctgaacaagagcaaggatgtgcttcacaacgacgtgatttacatgtccggagcccgagaggactccgtggcggaagtggccatgcagtataacgacggctacaacgagacgatcctctccttcgccaacaacgtccacacgccggagggcggcatgcacgaggagggcttcaagcgggctctcaccaatgtgctgaacgcctacggccggaagatcaagctgctgaaggacgacgagaaggtctccggcgaggactgccgggagggcctcacctgcgtcatttccgtcaagctgacagaggcccagtttgagggccagaccaagtcgaagttgggcaacagtgagatccggaccctggtgaataacatcgtctccgaaaagctggagatcttcctggaggagaacccccaggtgggccggatgatcctggataaggctctcactgccaatcgggcgagagaggccgccaaaaaggcccgggaatccatccgccgcaagacggctctcggcggcgccgccatgccggataagctgcgggactgcaatgagaacaatccggagctgacggagctctatatcgtcgagggagactccgcaggcggctccgccacccaggggcgggattcccggttccaggccattctccccctgtggggcaagatgctgaacgtggagaaggcccgggcagacaaggtctacggcaacgacaagctccagcccgtcatcacggccctgggcgcgggcatcggggatgagttcgatctgaacaggctccggtatcacaaggtcatcatcatggccgatgccgatgtggacggcgcccatatccgtactctgctgctgaccttcttcttccgcttcatgcggcccctgatcgaggagggctatgtctactccgccgttccgcccctgtataagctgacccgtggcaagaccacccgagtggcctttgacgacatccagcgggagaagatcgccgccgagatgcggggcgacaaccccaacgccaagatcgacatctcccggttcaagggcctgggtgagatgaacccccatgagctgtgggagaccaccatggaccccaccacccggacgctccggcgtatcacgctggatgacgccgtggccgcggacgagacctttaccatcctgatgggcgagaaggtggagccccggaaggaatttatcgagcgcaacgcccaatacgcggtcaatcttgactattgatccgtagggcggctgccctcggccgcccgtccgatcagatatgcctttgcgggccggcgagggcgccggcccctacaaaaaggagatacgatacatgagcaaaaagccccaatacgatcctgaggagatccggtaccccgaacagaagatcgtggagtcaccgctggtccccgagatggagaaatcctacattgagtacgccatgagcgtcatcgtgggccgggctctccctgacgtgcgggatggcctgaagcccgtccatcgccggatcctctacgccatgtacgaggatggcctcacggtggacaaacccttcaaaaagtccgccacctgcgtgggcgacgtgctgggccggtaccatccccacggcgatgccagcgtctatgacgctctggtccgcctggctcaggatttctccatgcgctatcccctggtggacggccacggcaacttcgggtccgtggatggcgatcccccggcggcctaccggtacacggaggcccggatgtcccggctctccgacgagatgctgcgggacattgaaaaggacactgtggactgggaccccaacttcgacgagacccgcaaggagccccgtgtcctgccctcccggtttcccaatctgctggtgaacggctccagcggcatcgcggtgggcatggccaccaatatcccgccccacaacctgcgggaggtgatcggcgcctgcatctgcgtgctggacaatccggaggctcagctcagtgatctgatgcagtacgtcaaggggccggacttccccacccggggcatcatcatgggtcgcagcggcatccggcaggcctatgccaccggccggggccgggtggtgatccgggcccggcatgagtttgaggagttcggcaaggaccgcacgcgcattgtcatcaccgagatcccctaccaggtcaacaagcgtatgctcatcaagagcatggccgaccaggtggaagacaagcgtctggacggcatctccgacatccgggacgagtccgaccgggacggaatgcgcatcgtcatcgagctgaagcgggacgccaatccccaggtggtgctgaaccgcctgttcgcccagacccagctgcagaccagctttgccatcaacatgctggccctggtgaataaccagtctcagcccaagatcctctccctgcgccacatcattgacgagtatctggccttccaggaggaggtcattatccgccgcaccaagtacgacctgcgcaaggcccaggagcgggcccacctgctggagggtctgctggtggctcaggacaacatcgacgaggttatcaaaatcatccgcagcagctacgacaacgccaaggagaacctgatgtcccgcttcggtctggacgatgtccaggcccaggccattctggatatgcggctgaaagcccttcagggcctggaccgggagaagctggaggcggagtacaaggagctggaggaaaagatcgcctacttcaaccagctgctctcctccgacgagctgctgcgcaaggtgctgaaggaggagctccaggccatctccgacaaattcggcgatgaccgggtcacggagatccaggatgtggaggatgagatcgacatcgaggacctgatcgaggaggagcagtgtgtcttcaccctgacccaggcgggctacatcaagcggacacctgccagcgagtacaccgcccagtccaagggcggcatgggcaagaagggcatcaccacccgggaggaggactacgtggtggatgtgtttactgcctccacccacgactatatcctcttcttcaccgacaccggcaaggtctaccggaagaaggggtatcaaatccccgagtccggcaaggctgccaaggggaccaacatcgtcaacatccttcaggtggagcagggcgagcggatccaagccatgatccatacccggtccattgaggacgacggccgcttcctcttcatggttacccggaacggcacggtgaagcgcctgccggccaatactctgaagaatctgcggaataacggcatccgtgccctgcggatggaggagggtgaccagctgatcgctgtccgggagactgacggcagccagaagatcctcatcgccacccatgacggtatggcagtctgctttgacgagaacgatgtgcggcccatgggccgggacgccgtgggtgtgcggggtatccgcctgcgccagggcgattacgtggtgggcgccgcccgtgccaaggtcaatcatgcggtgctggccatcacggaaaacggctacggcaagcagacgccggtggaggactatcggatcaccaaccggggcggcctcggcatcaagaactacatggtgacggacaagaccggccccgtggtgggcatcaaggtggtggacggcacggaggacctgttgttggtgacccaggcaggcatcctgatccgcaccccggtggacagcatccgcaccgcgggccgggccactcagggcgtcatcgtcatgcggttcaaggaggagggggatcacgtgatctccctggcgctcacagaccatgaggagggcagcgccgaggccgaggaataaggccgtccggagccggggcgaaaacgcttctgccggaatgtttatcagaacacagggggagctgttcccgaggagacggctcccccattcaaaaccatcttccaaaaggatttcatgatgaaaacagtcaccatctacaccgacggcgcctgctccggcaatccgggccccggcggctggggcgcgattttgatgtacggcccccacagccgggagctctccggcggagaggccgccaccaccaacaaccgcatggagctcaccgccgtgatccaagcactgtccctgctgaaggagccctgcatcgtggacctctggtccgattccaaatatgtgatcgatgggctggagaagggctgggccaaaggctggaaggctaggggctggaaaaaagctgacaagaagcccgccctgaatccggatctctgggacaggctgctgtccctgacagaggttcattccatccgttaccattgggtcaagggccacgcggagaatgcgtacaacaaccgctgtgatgagctggcggtggcggagagccagaaatacaagtagtatgtcttctgtaccccgcagaacggggcaggcgccgtacaagcggttcgacgacggcaaagccacggcggagtcggaatttcctctcgccgggcaaatcaaaaaaataggtcccccaccggctctgccgggcgagggaccatgcggagagcgcatacagcaaccactgtgatgagctggtggcggccggagatcctgatagcccccgcttccttctcatggggagaaaaagtgagagaaacagacctatcttccaaaaaaagacaagtttttctaaatttttccgctgtttacgaaaacagaaaaaaacattcacaatctgttcataagaaaaacataatttagaaaaaattttcggatatctttataatcaagcaaagggtcctcccaaacccgatgcgttttctccctcctaaaaacacacacagcacaaaggaccgccacatggcggtcctttgtgtgtttacggctggatcagctccttgctgagatggacgatgaagtcctgcacattggtgacgatgccccgggcggagaggcttccccggtcactgagtttgttcacggcaaattctgagatatccacgcagtagaaatacacctgccgcacggttccgtctgccagcacccggtaggagggggtcatgtttccggcggcgatggtgtgaagggcagtggccatgcagatcaccgtggtggcggagcggatctctgcccgcatggcgtcctgagcggcatagacgtctgccagcaccggcggcagaggcccgtcgtcccggatggagcccgccagtatgtacgggacgccgtgccgttcgcaggtgtgcagaatgccgttttcgatctgctccgctttcagaaaggcgggaatcgatccgtggagccgcacccggttgatggtgtccagatggttgtagtgcccgttgggctgactttcctgcgtgtagatgttctgccccagagcagtgttgaggtaggctgcctccagatcatgggtggccagcgcgttgcccgccagcacggcatggacaaagccgcctgcgatgagccgggagaaggcgttgcgtgcgtcgtggtcaaaggcgaaggcgggccccatcacccagactaccttgccgtggtcccgttcgtggcgcagcagttcatagagctcgtcatagtcccgggaaaaggcggtctcccgggagcggccctgccggaaggcaaacacatctctggcaacccggcgctcccggaagccgtccgggtggacgaggatcccctcctctccctgttctgtgcggccgacggccaccagatctccctgccgcaggcggcggaattcccggacgtcgatgcggccccgatcccacacggccacgcagtccatccggctctcccgggccagatgccactgccctgcgattttgaagtattccggaaagatgctcatggcgtggaaattctccggcgccacgccgtcccggggcgccgggcgaaagacggcgtccggtgcgttttccagtgcgggtgtggaaaagaccggcggaaaataggggcgcagctgaaacggcataatggcgttcctcctttgaaagatggtgccgctgttccacccggatgcagagaagaaaagcccggggaccgctcctcgcaatacctgcggagcagtctccaggcccatcggcattcccatccggcaaaagggcgcgggaggtttgattgcattcagaatatcagaatgccgccaaaaaaacaaggccctttcttgtaaatccgggccgtcgggtgtagaatatccaacatacaggtttttccttcaaggaggcttttcaacatgagagacggttttatctccgtggccgcaggcacccccaaaatccgggtggcggactgccgctataacgcggaacaaatttttaccctgatgcgggaggcggacaagcagggggtgaaggtgctggctcttccggaactgtgcctcaccggctacacctgcggagatctgttcctgcaggacacgctgctccggggcgccgaggagggccttcagaccatcctggaggctacaagaaatctggagatcgtgacggcccttggcctgcccgtgtgggacaaatgggacaacaaattgtataactgtgcggctattatacaaaaaggagagattttggggctgattcccaaggtctatctgcccaattatggggagttttatgagcagcggtggtttgcatccggcagcggcgtggagcacgggattgagctgtgcgggcagcatgtgagtctctgtacgaaccagacctttgcctgcgacaccatgcccaacttggtgatcggcgtggagatctgcgaggatctgtgggccccggcgccgccctccgtggagctggcccggaagggcgccaccgtgattctgaacctctccgcatccaatgagctggtgggcaaggcggactaccgccgctccctagtgacaggccagtccgcccggctgatgtgcggttatgtgtacgcggatgccggagagggagagtccaccaccgatgtggtgttcaccggccacaatatgatcgcggaaaacggtaccctgctggcggagcggcggttcgccaccggactcaccgtcagcgagatcgatgtggaccggctgatccatgaccgccgccggaccaacaccttcaccttcggcaaggagccgccggagatctggcggtgcggcttcacgctgccggtggaggagacccggctcacccggtacgtctccccatctcctttcgtgccggaggatgccgcgggccgggcggagcggtgtgaggagatcctgcggatcgcctccctgggtctgaagaagcggctggagcacaccggcgccaagacggcggtggtgggcctctccggcgggctggactccaccctggccctgctgatcacggccctggccatggggatgctgaatcggcccgccagcgacatcgtggccgtcaccatgccctgcttcggcaccactgcccggacgaagtccaacgcggagctgctggcggagcggatgggtgccacgctgaagatcattgacatctcccaggcggtgcggcgacattttaccgacatcggacagaacatggagaaccatgacgtcacctttgaaaacggccaggcccgggagcggacccaggtcctgatggacattgcaaaccagaccggcggcctggtgatcggcacgggagatctcagtgagttggccctgggctggtgcacctacaatggcgaccacatgagcaactacgccgtcaactgctccatccccaagaccctggtgcggcatctggtggcctatctggcccgggacaacgcggagaaggacgaggccctccatgacgtgctggaggatattctggacacccctgtctccccggagctgctgcccgctgtccaaggggagatcagccagcggaccgaggatctggtggggccctatgagctacacgacttcttcctgtactacatgctccgctggggcttcccgccccggaagatctaccgtctggcgctgtatgccctggggaagacctacaccccggatgtgatcctgaagtggctgaagaccttctaccgccgcttcttctctcagcagttcaagcgcagctgtctgccggacggccccaaggtaggttctgcggcactctccccccgcggcgactggcggatgccgagcgatgcttccgcggcactgtggcaggcagaactggagacactggagtaaacggaagagaggagccagttgccgaacatggggggcccaaaaaaatcaaagattttttggggaaagaaggagcaagggagcgtccggagcttttgccgtgggcagaatcggaggggagcggactttgcgacgacgcggcggatgccgagcgatgcttccgcggcactgtggcaggcagaactggagacactggagtcagtgcatttttaacagtatgtggaaagcggaccagggcgacggctatacagccggcgctctggtctttctatgcgtatacagataaacacggacaggcagcatgaactttcgcagttcttgacagattctcccccctcccattaaaatagaagaaaaattgtttgaaaacggaaaggaagcacacgatggaagaatctctagaacatatccgggagagcgcggagacacgaatgaggaagaatgccttcatgctccataattatatcgagctggaacgcgtggaaaaagaccgggcggtcttcaagctggacatccgcccggagagctgcaacccctatgggctgattcatggcggcgccatctacaccctggcggacaacgccaccggcgcggcggcccacagcgacgggcggtattacgtcacacagaccagcgcgctccacttcctgcgcaaccaggccacagggacggtgcgggcctctgcttgggtccggcaccgtggaaagtccacggtgctcaccgctgtggacatcaccggagagggcggcaggctgctggccacgggggagttcaccttcttctgtgtagacaaggcgctgatggaccagaaggcggccgctgagcagaaataagagagatgcgggagagggcgaacccctctcccctttttcccaaacactgtggaaaaccgggctgtcatatctccgcccgccgccgcataaggttgtcccagaggtgaggcgatatgaagaggccggtttttccaggcccgttcagaagagggctccggcggctgggcgcagccgggctggcggccgggaccctttgggcggttgtggtcaccgccggaagcgacagcgcgtctgcagcctgggcggccctgcgggcggcgtctccgctggcggcgctgaaatgggagctgggggacctgtgggcgaacgatgacctctcccccgccgcggtgatgacgttgggagagtctcccctgctgttgtccgcccgggcggctgtggcggagctgtggtccaccgagcggacggaggaatccggtgcggacggccgggaggagactgtcacggagccggtggaggagacgccgctggagaccacgggagagacggacaacggcgttccggccagaacactggtgcctacggaccccagcggctatacggtctgcggccggtcctacatctccaacagcacggaccacgccctcaccgtcacggagctgtcggagccctttgacgcccggctcgccgatggggagcctcagattctgatcctccacacccacggcagcgaggcctacaccccacccccgggcacggacatcgtctggtccggcaactaccgcactacggactcccgctacaacgtggtgggggtgggagacgagatggcggaggtgtttaccgccgccgggatctccgtcctccatgaccggacactgtacgactactcgtcgtacaacgacgcctataacaacgccctggcggccattgagacctatctggcggaatacccctccatccgcttcatcctggatgtccaccgggacgccatcggcgacgcggagggcaatcagtacaaggtgatctcggagatcgacggggtgggcacctccgcccagatgactctggtgatgggcagcgacggcagcggcctggctcatgagcactggatggagaatctgaaactggcggtggcccttcaggacaatatcttgcaaagctatcccaccctgatgcggccgatcctgctgcggaattcccgctataaccagcacgccaccaccggctccttgctggtagaggtaggggccgccggcaactctccggaggaggccgccctggcgggccgcctgttcgcccagcagatggcggactatctcattgatctgggcaagtgacagaggcggtcctgcggagagcaggccatccggccccggtccgacggcaaaagccccgtccgaacggacggggctttttgctttgaaggctcagggctcctccgccagggggaaggacaccacagcggtgaacaagtccgccagcgtctccacgtggaaatctccgccgcaggcctcggtaaaggagctggcgatggaaaggcccaagccgctgccgccatcggtacggctggcgtcgccccggacgaaccgggccgtcaggtccacgcctgtgggcagctcctcccgggaggtgttgcgcaggctggcctccgccctgcccacctcggtctttaaggagaggtagacccggcttcccgccagggcatatttcagggcgttgtcgatgaggttctggaacacccggtacagccgccggccgtcagccgtgatcatcaccggtatctccggcagctccatccggaaggtcagcccgctttgggagataggcccctccaggtccgccagggtctgccgcaggagcttggcaaaatccagccgctccaagtggaccggcagctggccggaggcggccttgctgacctcgaacacatcctggaccatcactgccagccgtcgggccttctcgtcgatgatccgggcgtagtccgctgcggccccctccaggggctcctgccgcagcagttccgcataggagagcacagaggtcaggggcgttttcaggtcgtgggacacgttggagatcagctctaccttcatccgttcgctgcgggtctgctctgccagggcccggtgcaggcccgcctggatgtcgttcagctgctccgcggtctgatgcaggtctgcgtccgccggcaggtccaggggcgtttccagatccccgtcccggatggccgtcacttggtccgccagcaggccgatatcccggaccagggtccagtcccgccggatccagaagatttccaggacccctatcagcgcaaaggcgggaacaaaaacgcagatcacagtcagagaagagttccaaagcatttcatacacagggacacagcagagaacagctgtaagcataatggcccatagtgcaaggttccgcaccagagaccgccgccggagccgcttctgcaccggcagcttcaagtctcttgccaagaatgcgtttttcagccccctcaacagactccgccgctgctccctttccgtgtttttccgggtgatgtgccgcagccacagcgcccacaccagcgccagcagcgccggggcattggcgggcagcagcgccgccagccgcagggcgtccgtcacggtcggacccacccagccgtaataccagaattcaaagggagagtagccgccgaatcctgtggagaacaccatggagaggactgccagggcagccgccagccaccagatctccccgggcacgcggcgagtgagagcggccagctttttctccgccttccgccgttccgcccgcaggagacgggtactcaccagatacgcaatgccgagcacacacagcactgcccgcagcaggtagaacttctgcatcccctggatgcgctgatacaggctgtagagatcgttagcggggcgggacgccccgccgctgttcggctggagataaggcaccggctcctcccggacggccatgtagacggtcacatccgccgcgtcctccccggccgtgaaattctcatagccggggacgtcccacagggaatcctctgtaaaaaatccatcgccgtaaacgtccactggctctccatccttggtgatggtgactgtaccgttctggaaggtcagcagaaagttgtagccctccggcacggcccagctggaggagaggatcatattcgctggagcattgctgtaataggagtcctcccccgatccctggacccggtagaggagattcttgtcctctacataggaggcgtctggcgcctcctctttcggggttgctatatcttctgtggcagtgtccgtggatccccactcgtaccaggtgatgccagcactggacacgacgtaggtatccccggaagcagtatcccaccactccaggtcgctgccagtggccatagccagaaaggcccgcagccgttgggccacctcctgccggaaggctggggtctcctgccagtctgtactccaccatccgctgccgaaggagccgctgtcgaccccgctggccaggcggcccgccgtctgtcccaggctccccagcaccaggctcacgcccagtaccagggccgccagtccggccgccgcccgcagcctgccgcaggtctttccggagacgcggaccttcgccacgcccggggcgtcctccacccccttcagagcctcccggacctccccggccacaagttgttccagaccttcgtcaggtcccgtgctgttccattttgtatccaatgccccacaccaccttgatgtaatctggctccttgggattgagctcgattttttcccgaatgcgccggatgtggaccatcaccgtgttttcgcaggcgtaggccgcctccccgtcccacacccggcggtagatctcctccgccgggaagatgcggccggggttacgcatcagcaggtccacgatctttgtctccgtggcggtgagcttcaccgcttccccatccgcccgcagttcccggcggtccgggtcgtaggtgaggcgcccgttgacgatgaggccctgccgctcctccgcgtggacgtccccagcagggtgtaccgccgcagctggctccggactctggccgccagctcctgggggttgaagggcttggtcacatagtcgtccgcccccatggagaggcccaggatcttgtccgtgtcctcacttttggcggagaggacgatcaccggcaggttccgcttttcccggatccgcagcagagcggacagcccgtccagcttgggcatcatcacgtcgatgaggatcagccgcaccgccgggtccagggccagatccagagcctccatgccgtcataggcccgcaggacccggtagccctcccgctccagggtgatggcgatggcccccacgatctccggatcgtcgtctaccaccagaatgcacgcgttcatctcgatccctccttgagctgattgtagcataccagggaattcttacaaacacccggagaaatttcttacagatttcttacggtttcaagcggcacaaaaaaagggccctcccgggaaggaaagcccttcttttcaatggctcactttttcagcggcatggagaagaggaaccgggtggaggcctggtcgctctcggccttcagagttcccttgtgctccgtcgcaatggaggcggcgatgggcagccccaggccgaagccggactgctccccccgggaggcgtccgcccggtagaatcgctcgaacaggcggcccagctggtccggtgggatgggatcgccggggttggataccagcagacgggcctgccggtctgtgcgccgcagggtcaggctgatggtaccccccgcctgcccatacttgatggcgttgtccagcaggacgccgatcagctggcgcagtttgtcggcgtcgccggtgacggtcacgtcgggggtgatgtcgctctccaggggctttcccgcctcaaaggccaccggctcaaaggccagtacgcagtccgtggccaggtcggagagcgagacctcccccatcaccgccgtgggaaccgcattgtccgcccgggccagggtcagcatctcctccaccagggacttcatctgtccggcctcggagcggatgttgtccgcccaccgggccgggcggtcctccagcggcgccgcctccagcagttccgcattggagaggatcacggtcagcggcgtcttcagctcgtgagaggcgtcggaaaggaactgccgctgctgctgccaggcttttgccaccgggcgggtggcccaccgggccagcaggatggagacgcccagaagcagcagcagcgccgccagaccgatttgcagataggagcccatgatctcctgcaatgtggcctgctccatggacatgtccacaaaggcgatgcgctcgtatagtccatagtcccggcgcagataccgcaggccgtagctgtggatagtgccctcgggccggttctgctggagacagtcggtaagaatggtctgcagctcctgtgtgtcctgcagattggaataggtcccgcctgtgacaaaggcctcgtagattccgctgcggtcccagagattcaccgtgaaatagggcagcagaacgtcttccccgccccggttgagccccagatccggccggccgctgggagtgtcgtcctccatgacccgctggagcacctgatggctgatgacctcgatgttctgcttggcggagaaaaacacagccgtgaataccacgcccagtaccgcggtcaccagaatcatgcacatggccacgaatttgatctgcaattttcggatcatgggaggatcgcccccttcctgtcgaaaactctgtggaaaagtggaaaaatgtggactttgtggaaaactacgcctcctcaggcgcttccaggcagtagcccaccatgcggatcgtacggatcttcacctgggagtggagatggtccagcttcttccgcaggaaggagatgtagacctccacattgttgtcctctgcgtcggactcatagccccagaccttcagcagcagcttctccttggtgatgaccagcttctggttcagcatcagcatctccatcatgtcgaactccttccggctgagccgcacggagcgctcgccgcaggagagggtgaaggaggtcttctccagccgcaggtctccgtatttcagggcatcagtctgccgcagctccggctggcggcgggtcagggcccggatgcaggccagcagctccttgggctcaaagggcttggtgagatagtagtccgcaccggagtccagcccgttcacccggtccgtcagctcggaccgggccgtgagcatcagcaccggcgtggtgctgccctccgcccgcaggcggcgcagcacggtgaagccgtccagcttgggcagcatcacgtccagcaggatcacgtcataaatggaggtcagggcgttgtccagccccgcctcgccgtcgtggcagacgtccaccgtatagccgttcagctccaacaggtcctggagggtggcggccaggcggacctcatcctccaccaccagtacgcgcatgaaatcacctccgtttgcaggatcgcgcgccgtttctgccggcagcgccacacaggggggagcccgggggctccccctggtcagatgagacggatgggaaacgagatcgagtttattcgcccgtggcgtccgccgcagtcaggccattctccgccacagagagaatggtgtccaccgaagcggtgtccatctggtagatggtggaatccccctccatgcggacgtagtagccggtctggtccaggttctcgctgccgaaggtcagggtcagcgtcccctcggtaccggtgtcgttcaggtagagaatggtaaccgtggcctggggtgcgtcaaagccgcacagggcagcggcctcgtctgtgggcttgtagtccacgcatttggtgaaggtcagcgcccccagctccgccagcagagaggcggtgtccgcgttgccggtgacgtcctcgccgctggcagcccaggtgacggtaaccgtttcctccccggtctcctcgtcggtggaggtctccttgtcgatgggccgcaacagggtgctggcggcgccctcaacggtgacggactggaggttttcctccgtcagctggggcagctccggcaggtcgcacatgtcatagatggtcttggacatctcggtgtacagggagttggagatgatatacaccggactctcctgttcgttcatcagcatatagtagctgttgccgtccgtagtggtgttgcccagggagatggtcagcgtcccgccgtccggcttggctgcggtcagggtggcgaagggttggtccaggccataggcctccagcgtatcgccctctgtaatggtctgctggggtttgaggttggtgagaagggtcaggatcgactggatggtggagtcgtccaggggaaactccgggtcgtcggaccagacccacttgcccgcctcgtccagatggaaggacagcgtggcgttgccgttgtcataggtgagggacgaataggcggcctccgtctccgtgatgacgctggcggcgtcctgggcggcggcctcctcagcttcccgctgggcgctggaccgcttgacggcggagaccaccgccagcaggatgcccaggcccaccaggatccccagcaggagaaccagcgtcttcttctgtgttcgattcatgcttgtatgctccttcgtcacagtttccggcggtgcatccagcggacaaagccgtagatcagcagcgccgcggggatcaccaggataaacagcaggccccagatgccgccggtcgtgatggtattggtgggcgtcaacaggctcaccggctccacagagatggcggatacatcgtcaaagcccacagtggcggagtggatgaagagatccacgttgtcaacattggtaaagctgttggtcacatcggtgttgatcagcgtgtccgcgccgtagaccgtcagccgggcggtggtgtcctcgctgatctcctccgtggccacggcacccaccacataggtcccctgggtcatgttgtccgcgtccagcacggcatagccgttctccgtggtggttaggaagggctggacggtgatggtgtcccgggtgggatccgccagggtgaagccccgggaggcataaaacaggaccatggaatcacttgtgaggctgctggccgcatccacagaggtgtccgcctgcgcgaagaacagataggggttgttctgatagccctgggaggtgtccgcgatcatgccgtccgccacctgcattccataggcggcgcacagggcgttgaagttgggcaggtccaccagctcaccggccatgttgtagatcacctggccgccctccgccagatagttcaggatcatatccagctcatcgtccgccagatcctggtccggctcgttgaggatcagcagggagcagtcctcagggatgccgccgtcggtgagcaggttcacccgctccacggacatgtggagccgcgtgaaccgctccttcacgctgatggggacggcggtctcgttgtggcctgtggtctcgtacaccatccgggtcacgccggtgagcacgctgtcgatggcggaggtcagcaggctctccccgtcgaagtccgtctccgtataggtgccgtaatagtaatacgacatcatatcatacccgattatgtcgctgatgtcaaaggactcctgccggccggtggcctcgcaggtgaccacgatggtatccgcccccacaccgtactgggacagggcggagggatagaccgtggggtcggtgtattccagggtcaggtggtcgctgagatctgcgtagatgtccagaaagcggacgatccgggtatccagtgtgtccttgtcggtgagcacgtggatcaccacgtcatcctccagccccgccaggtagtcctgagaggtctcgctgatgttgtagatcccgctgcccgtcaggtcgatctgggcccactgctccggcagctgtgccgccagcaggttgaacaccagcactgccgccacggccagggccgtcagtccggcggagaaggcgcccctgcgggaggcgtggcgccccgcggtctcctgcaggctgtttttccaatcacgatgttccatattcacacgcctcctctcagttccaccggcgcttctggatgacctggacggtcagaaagaccagcagcgcgctgatggacaggtacagcaggatcccgggcacgtcgaagacgtggtccgtggaaaagctgtcgaaggcggagagcagggagaacttgcccagcacatccggcagcaggttggcgaagacggaggagtcccgcaggtagaaggcgatcagcaccgcggcgccggccaccagcacgccggctgtgaccttccagttgttggacagggcgttgatgaggaagcacaccaggatcagcaccacgaagaagcccagcagagacccgacggcggtggagggcagaaagcccaccaggccgtcccacagatacagcaggagcagcaggccgaaggtgcccactgcggcgatgatctggctctccgtcagagaggagatcagcatgcccacggcgatctccaccgcgcccagcaggaagaaggccagaatggcgccgtagtccgccaacaggaaggccgtgccgttcagcgcgatgatgagggggcacaggcaggcaatggccaccggcacggcgaacaccgtcagcatggcgaagtacttccccagcaccacggcggtgacggataccggcgccgtcagcagcagctggtccgtcttggtgtggcgctcatccgccatggagcgcatggtgagaatggggaccaccaccatgaaaatgaagagagaggagcccagagagagggagaaataggggtatccctgaaacaggttgtaggcaaagaaatagatgccgatgaagaccgtcagaaccgccacgaagatccagccgatcatggagttgaaataggagctgacctcccgcttataaatcgctttcatcgccgaccgcctccttttccgcagtttccacagaggtctggaacagcgccgccgcccgggcggccaccgtatcgttatcgtccgtcagatccaggaagacctcctccagagaggccgtccggggccgcagctccagcaggggcagccccgcctctgcaaaggcgaagaacagcgcctcccggatgtccctctccatgtggatggcaaatcgggctgtgtcctccgtccgccccagcagggtccggccggtgatgcccgccacccggtccagcacggcccccgccgcctccggcgcggcctttgccgtcagttccagggagcctccggcggagagcttctcctccaggtcctccggggtgtcgcacaccacaaaccggcccttgcggatgatgaggacccggtcgcataccgcccggatctcagagaggatatgggagctgaggatcacggtgtggtcctttgctagatgccgaatgagatcccggatctccaccacctgcttgggatccaggcccacggtgggctcgtccagaatgataatcttggggaagcccaggatggcctgggccaggccgacccgctggcggtagcccttggacaggttccggatcagccgggcgctcatatcctccagatgggtcagggccaggaccttcgtcagctggtccgtccgctgctccttggggatcttcttcagctccgcgcagaagcgcaggtactcctccaccgtcatatcaggatacagcggcgggatctcggggagatagccgatgcaggcacgggcggcctccggctcctccagaatatcgtggccctccaccaggacctgtccctccgtggccgccagatagccggtcatgatattcattgtggtggattttccggcgccgttcggccccaagaagccgaagatctggccgtcctccaccgtgaagctcagatggttcaccgcatagtggtcgccataacgcttcacaaggtttttgacctcgatcacacaaataacctccttcaggaatggagacgggcagggcccgccccagtcagctttcacagtataaaaaaagaaactgaaaactatctgaaagaatgaacagaacttcataaactgttcaaactttttaaaggttgtttttagattttgggggtatgatacagacatcctccaaaaaggataactgatcccccctctcttttttcatttttcatttcctttctctctgcgtgcggcggagggcgtccatgaccaggcgtcctccgccgcacgctgtcttgcgcgaaaagggcgaaaaagacggaaagatccggccggtccaggactttccgccgacttgttcttgcaaacagccggtgtttccgatataatgattccgcaattctaagtagccgggttcagaatgcgactgcccggtgaacaatggaggaaaaaagaatgagaggcgtacacagcgcggtggatgagatccgccgcaatgtcttcaccgaagtggcccgcctggcctatgagggcggggatttgaagcgggtggacatgatcccctacaccatcgttcccggagaggtggcccgccaccgccacgacgtgtttctggagcgggccattgtccaggagcgggtgcggctggcccttggcatgagcctgcagcccgctggcgagcagacgcccgtcagcgccggtatccaggaggcggccgcggccgacgacaaatattttgaggagcccctggtcaatatcatctcctttgcctgcaatgcctgccccccaagcagatccggattacggacagctgccagggctgcctgtcccatccttgcatgaatgtgtgccccaaggatgccatttatctggacaaggacaagcattgccacattgaccaggacaagtgcatcaaatgcggccggtgcttcaaccagtgcccctaccacgccatcagcaagattgagcgcccctgcgccgcagcctgcggcatggacgccatcgaatccgacgagctgggccgggccaagatcaactacgacaagtgcgtctcctgcggcatgtgcttggtgaactgcccctttgccgccatcgcggacaagagccagatcttccaggtcatcaacgccatgaaccgcggatccaaggtcatcgcctgcgtggcccccgcctttgtgggccagttcggcaaggccgccacgcctgccaagctgaaggccgccatgcggatcctgggctttgacgatgtggtggaggtggccatcggcgcggacctgtgcaccgtggaggaggccaaggatttcctggcggaggtgccggagaagctgcccttcatgggcaccagctgctgccccgcctggtccgtcatggccaagaagctgttcccggagttcaaggactgcatctccatggccctcacccccatggtgatcaccgcccgcatggtgaagaaggaccatccggatgcccggatctgcttcattgggccctgcgcagccaagaagctggaggccaaccggaaatctgtccggtcggatgtggactacgtgctgacctttgaggagctgcagggcatgttcgatgccaagaacatcgacttcaccaccctggaggcggacccggaggacggcctgaacgagggcacctccatgggccgcggcttcgcggtgggcggcggcgtggccgcggccgtggtagaggccatcaagcacatcgaccccacccgggaggtacagatcgagtacggcgacggcctgcgggagtgcaagaagatgctgatgatggccaaggccggaaagcgcaacggctatctgctggagggcatgggctgccccggcggctgcgtggccggcgccggcaccatcacccccgtgcgggagagcaccctgaatgttgagaagttcaagaaggaggccgcggaggtcagcagcaccgccagcccctatgtggaccgtctgaaagacgtggaggaataaccgctaaagcaagaaagcgggccacccaaaagggtggcccgctttgtgcgttttccggaaaagctgtggttctgcttacatttggtacagaagaaccatcagcggcatggtcccgatacagagaagcgtggtgattacattaatggcgccggcgtagtctccttcatgaccgtaaacttgagcgatctgagtgacgttagccgccgcaggggcacttgctgccagcaggctgatcatcaggatggactggccgtccggcaccagggccgcaaggccagagtatttgaaaatacacaggaccaccagcggcagggcgatcagccgcaggaaggccaccttccagatgctgcggatgcgcaggaccgccaacaggttctgctctcccatgagcatgccggcgacaaacatgctgagggggccgatggtggaggcaatggacttcatggtaccggcgatcaccgtaggcaggggcaggttcagcagaaacagcagcacacccacaaacacggaaatgatgttgacattcaggagaatttttttcagcgagacattccggtcaccactcagaataatccggcagtgactccacatgggaaactgctgcaccaactgaaacatgctgcaatagatgacccactccggccccaggaccgcagtcaccagggggatgatgaggttaccggaattggtgtaaatcagggaggcctgttccaccggcgtcagacgcagggggcggtgcagtaaggccgtggcaatgaaaaacagagcgtggatgccaatggcggccccaagggagagggccagaccctgaagcagctccggcgtacgctggagctggaaggcgttgatgatgacgcagggagtgaccagatacagacagactttggacagaacccggctgtcctccggcttcagcagatgcaggcggaccaggagccagcccaggacgatacacagaaaaagctgtacgatctgttcaagcagcatcaataccatgaaaacgttcctccatctacacacaggtgcgagtttaatcgtaccacgccaaaagaggaaaaacaaccagaaagtttatatagcgtaaaaaaactgggactgcagtaaaaaggctcccccatccagcggatgggggagcctttgttcagtcacggtctgcctcagtcggtgacgtagggcagcagggcgatctgccgggcgcgcttgatggcctcggtcagctgacgctgatgcatggcgcaggtgccggtggtccggcggggcaggatcttggaacgctcagagacaaagcggcgcagcttggcggcgtctttgtaatcgatatactcgcatttgtccgcgcagaactggcagaccttgcggcgcttgccgcggttggggcgagcgggtctcgcttcacgatcaaaagccatgaaatggttcctcctttatcaaaagtcagaacggcagttcgccgtcctcttcgccgatctcggcgaaatcggattgtccgcccatcggtgcggcgttgcggccgcccatgggggcgctgtaagaagcgggtgcgccgccgaaatcgccggcgccgtcccgtttggaatccccgaagtagacattgtcggcgacgatctcggcgcttctgcgcttgccgccgtccttgtccgtccaatcgcggatctgcagccggccctccaccacggccatgcggcccttggtgaagtatttgctgacaaactccgcggtgctgcgccaggccaccacgtcgataaaatcggtctccttttcgccgctctgggacttaaagtcccggtccacagccagggagaaggacgtgacggcggtgccgcttccggtgcggcgcagctcggggtcccgggtcagacgacccatgatgatgatcttgttgagcatatcaatgcccccttactcgcccttgcagacgatcagggaacgcatgatgccgtccgtgatccgcagaacacggtccagctccttcgggaaagaaggctcgctggtgaaggtcatcaggacgtaataaccctcggtcttgtagttgatgggataagccagcttgcggctgccccactcttccacttccacagcggaaccattctgctcagccagggtcttgaacttggccaccagcgcggcggtgttctcctcaccctgtgcagggtcgatgatatacacgacctcataattggcagaaacctttgccatatttgcacctccttctggacaaatggcccccattcgggatgggagcaaggatatgcctgcagactgcaagccatattattatatcggaatttctggaaatgtcaaggaatttttctcccggctctataggggggcaaatctttacacaagatactgcttgacaaattcccgcgggcggtgtcataataaatgcgacaaaaacaggggagccctcacgggctgagaggaagcggaccgcttcgaccctttacctgatgtgggtaatgccaccgtaggaagttatgtatgagcatccggcacggcgggcaccctctcaggcgcccgctgttttttactttgagacggaagggatgtgcatcggcgaaaacaacatccggcgccccggggaccaccgggagcgggctgagggggagcgccctgggcctgggccggcaaaacagcgatgggaagccgtgttccggcgtgagaggaggccagaaagcctcgaccgattttccacagcaggcggatgcccgcctgccgaccttgcatggcaaggggaaaacgctgtttcgcacgctgttttctccctgcaaattctgatggatcaaaggagcgatctctatgaaaaccaattccaagaagctggccctggcaggcgtgctgtgcgccgtggccgtggtgggcagtatgcttcagtttcccgtattcggcagccagtgcgcgccagtgcagcacatggtcaatgtcatctgcgccgtgttcctgggcccgggctacggcgtggccgtggccttcctggccagcctgctgcgcaacatcttcggcttaggcagcctcctggccttcccaggcagtatgtgcggcgccctgctgtgcggcctggtctactggaagaccaggaatctgcccgcgaccctggcgggcgaggtgttcggcaccggcatcatcggcggcctgctgtcctatcctgtggcggtggcctttatgggcgtagtggccggctccatcgccttttacgcctatgtggtgcccttcctggtctccaccgtgggcggctccattctggccggcatcctggtattcaccctccagaagagcggcgccctcaaatccatgcgggccgcattggagcattgatcccaactgagaaagggtccttccatgcttgatttcacccgtctggacaaagtccgccgccagcggcccctgatccactgcgtcagcaatatcgtcaccgccaacgactgcgccaatctggccctggccgttggcgccagtcccatgatggcccaggcaccggaagagatggaagccatctccgccgtcagcgacgccacggtgctgaacaccggcaccccggatgcggagaaattccgggcctgccggatctgcgccgtctccgcccgtcatccggtggtgctagacccggtaggggtgggcgcaagtccctggcggctgggacaggtccgggcgctgctggacctgttcaccccgtccatcctgcgagtgaatctgggggaggcccgggccctgctggggtcggatgggcaggaacaaggggtggacagcccgctgcccgccagccgggaagcccggagggacaccgccatggacctggcccggcgccgcggaacggcggtgctgctctccggtccggaggatctcatcaccgatggggcgcgggtctggtgcgtcaccggcggcagcggccggatgtctctcgtcaccggcacgggctgtatgctgtcggtgctgtgcggtgtgttcgccgccgtggagccggacgccgccgcggcggctgccctggcctccgccttctggaagatctgcgcccgccgggcggagcacctggccgcagaccggggcagcggcagtttccgcacggcgctgctggacgccgccaatacgctgacggcatctgacgccgcccgcgaggcggagatcctgactctctgacaaagaagcccgcccggtcctgacggaccggacgggccttctgttttgcgaggcaggcgatcactccagctcccgggtctcaaacatctcctcaaaggaacggatatagtagtccgccagcccgcggatctcctcctggtgtgcctcctcggacgcgtcgtacaccgccgccacccggaacccggcggccttggcggtctggatggcgtggaaggcgtcctcaaacaccaccgtgtccttcttgttggactgaaggcggcgcatagcccgctcgtagatctcggcgctctcctttttgccgacccccacctccgccacagtgataagtccccggaagtagtggtcgatccctgcatggcggagggctgcttccgccagagggcggtccgtggcagtggccacatacatccacacgccctccatcttcagaagggacagaaacttgtccacgccgggctttgcctggacctcatgctgatagaaatccgcgacccggtccactacccggccgatcagctcctcctccgtctgggggaggtggtagtgctccttgcagtaggcgatcccgtgccggagggagagggtcttcagcatctcgtcggtctccggctcgggctcgatgccaaggccccgcaggacgctggtacccaggtcccgccagataggcatggagtccagcagggtgccgtccatatcaaaaatcgcgctttgcagtctcatgggaactcctttcgtctgttgccgatggtccctattgtaccaccggagcaggcaaaagcgcaatgaaaaccccgtgaaaaggaggaaaaattcatgcgtctctttctggccatccagctgtcccccgcggtgcgggaagcactgctgaccgctcaggacgccctgcgccgccagggcaggggctctttcccgccgccggagaacctgcacctgaccctggccttcctgggggaggcagaggacccggccagggcccgggccgccctgtcggaggtatcctgccgacctttctccttggcggtgggcggcccgccggggcatttcggcgacctgtggtgggccggtgttcgagcagatccggccctggaggagctggccgtgtccctgcaggcggacctccgctcccggggcttctgccaggaggaccgcccctggctgccccacatcaccctggtccgccgctggcggggcgaggtcccgcaggtgaccgtcccccacgcgagcatggtggtccggcagatctccctcctgcggtcagaccagattgacggcaaacggatctacacagaactctcccacaaatccctgcgttaaaaaacagccggcaccgttaggtgccggctgtttttgcagcggaaaggggtctaggggaaaacctaaggttttccccagttcgttcgccgttggcgaacgaagaaatttcaatcattttcgccgcggcgtgtacgtggcaaaaatcccttgacccgtgcgccctgggcgcacacaccagtccgcagactggtggtggggaggtcgaggggaaacagccgaaatgccgccagcggcggaaaaagtgagtctgtttcgaggcagcggcgcgattggcggcccgaacagggccgggaattgcaatgccgcaacggtgtcagcctgctccccctcgaagccctcagcacagcttcgcgcccgccgggatggaatcatccaccatgatgaggtgcaggcactcctcaccgtgctcggtgtggacggcggagatcagcatgccgttgctctccaggcccatcatcttccggggcggcaggttcacaatggcgatcagggtcttgcccaccagatcctccggctcataccacttgtggatgccggagaggatctgccggtccacaccggtgccgtcatccagagtgaatctcagcagcttctcactcttcttcacggcatcgcaggccttcaccttcaccgcccggaaatcggacttgcagaaggtgtcaaaatccaccttctccgtcagctggggctccacctcgacggcgggcagggcggcctttttggccgcagcctccgcggcctccagctcctccagggccttgtccatgtccagccgggggaacaggttctcgcccttggtgacggcagcggtctcaggcagagcgccccactccgccgcggcgtcccaggtccgactctccgcaggggcgccgatctgggcaaagagcttttcacagctctccggcatgaagggcgtcagtaggatgccgcagatgcgggtggcctccagcaggttgtacagcacatgggccagccgcttgccgttggtctccatatcctttgccagggcccagggggcgttctcgtcgatatacttgttggcccgctggatgaccttgaagatctcgtccagagccttgtggggggcgaaggtctccatgtcctcctcatagtcgaaccggagccccgcggccttgctcactaggtccaggtcaaagaggaccggatcgttgggatcgtcagatccgaagcacatcgtggatgcccggcttgcggcagacctggcggtctctttctccatctccgtggcgccgcacccggcaggcagcgctccgccaaagtacttgcccaccatggcggtggtgcgggagaccaggttgcccaggtcgttggccaggtcggtgttgatggtctggatcagcagttcgttggagaagttgccgtcggagccgaaggggaacgtccgcatcaggaagaaccgcagggcgtccacgccgaacttctccgccaggatatacgggtccaccacgttgcccttggacttggacatcttgccgccgtccagcagcagccagccgtggccgaacacgtgcttgggcaccggctcgcccaggctcatcagcatggcgggccagatgatggagtggaaccggacgatctccttgcccacgatgttgacgccgggccaccagcccttgtcgtagtcgtggtagcggtcgttgtcatagcccagggcggtgatatagttgctgagggcgtccacccacacatagactacgtgcttgggatcgaagtccaccggaatgccccaggagaagctggtgcgggagacgcacagatcctccaggccggggtccaggaagttcttcaccatctcgtggacgcggctacggggctggaggaagtcggtgttctccagcagatcccggacctggtcggcgtacttgctcaggcggaaaaagtaggcctcctcctccgcgtcctgcacctcccggccgcagtcggggcacttgccgtccaccagctggctctcggtccagaaggactcgcagggggtgcagtatttgcccttgtaggtgcccttgtagatgtcgcccttgtcgtacatcttcttgaaaatcttctggacgctctccacatggtagtcgtcggtggtgcggatgaaccggtcgttggagatgttcatcagcttccacaggtccttcacgccccggtctccctctacgatgttgtccacgaactccttgggagtgacgccggcctccctggccttggtctcgatcttctggccgtgctcgtccgtgccggtgaggaacatgacgtcctcgccccgcaggcggtgataccgggccagcgtgtccgtggccaccgtacagtaggtgtggccgatgtggagcttgtccgagggatagtagatgggcgttgtgatatagaattttttcttttccatgggattctctcctttaaaacggcagctccgaatggaagagcgccggtatttgcctgaattattattatagtttgaaaatccaaaaaatacaagggaagatgcgaaaaacgggccgtcacacaagccgcctctcctcgtggggattgtatttttcgcaaaattccgatacaataggaacgctgtatgattttcacaagggaggatgcgcccatgaaactggtatcctggaacgtcaacggcctgcgggcctgcctgggcaagggatttctggacttctgtgccgtggccgacgcggacatcatctgcctgcaggagacgaagatgcgcccggagcaggcagaatttgatctgcccggctatcaccgctactggaacagcgccgacaaggcgggctattccggcaccgcggtgttcacccggcgccagccgctctccgtgacctatgacttcggtatcgatgagcaccgccacgaggggcgggtcatcacggcggagtacccggacttctacctggtgtgctgctacactccaaactccaaggatcagttggcccggctggactaccgcatggcctgggaggacgacatccgggactacctgctggatctggacgccaaaaagcctgtggtgtactgcggggacctgaacgtggcccaccaggagatcgatatcaaaaatcccggtcccaaccgccgcaaccccggctttaccgacgaggagcgggagaagatgacgaagctcctctccagcggctttgtggacacgttccggtatctgtacccggacaagaccggggcctactcctggtggagctaccgcttcaatgcccggaagaacaacgccgggtggcggatcgactacttcatcgtgtcggagcggctgaaggacaaaatccggaacgccgatatttggagcgaggtgctgggcagcgaccactgcccggtggtactggatctggatgtataaacttcacgcgcgttcgatgcgccacgaacatcggcaaatcctgcacatgaagtctttttgcatcatttccggctgccctgaagagtgcggggaaacggcacatttcaaaggtttgtgatgctttgcatcggaaaacaggaccggacctgctgggtccggtcctgtttcagctcaacagggcgttcatctcctcgatctccagatcctggagggcccagttgatgccgtagcccaccaccttgctcagatcccgcacctgctggtcgatgtcccgggtagtgaccatgaaggcatcatgctccccgcgcagccgttcctcatccaccttttccacgccggactcctccagaatgtccgccgccagggtggcggagtccaccaccgtgggcacgccgatggcgaacaccggcacccccagcgtctcccggttcagcgccgcccggtggttgcccacgccggagccggggatgatccccgtgtcgctgagctgcaccgtggcgcacacccgcccgcaccggcgggaggccagggcgtcgatggccaggaccatggcgggctggacttccgccaccaggccccgcaccgcctccgcggactccacgccggtggtgcccagcacgccggtgcggaaggccgacaccggccggaacccggcaaactgcttcggcatggcggagagcaggtgccgggtgatcagcacgctgtccaatgccagggggccaacggcgtccggcgtcatggctgcgttgcccaggcccaccaccagggcggagccctccaccggcagcagggccttcagctccgtgcccacggcccggaccgcccgctcgaaaaagtccgccttccgctgccagaaggtggtgaggtcaatggtgaaatagctgccctggggcttgcccagggcctcctcgccccggtggtccaggatgtccacccgggtgactgggtatccctccagcttgctcttggtcgccttcacccccatgaggcgggtggtccgctccgcggactcctgccagagctcccgggcctccagggccaggtcggtacgttttatgaacaatgcgaaccgcctcccaaacacaaaatctagtggtctgctcactaggttttgcggtaggcggcacgatatacaattttagcccgaaaaatataaaaaaaggcttgctttttgcgccgttccctgttaaaatatcattctgcatggtgggaactggttcccacagtcaaattttctgcctaaggaggtgtttggtttgccgaatatcaagtctgccaagaagcgcgttctgatcgccgaagtgcgcaacgcccgcaacaaggccgcgaagtccgaactgaagaccgccatcaagaagttcgaggctgctgccgcagaaggcaatcgcaccgaggccgatggcgcgtacaaggttgcagtgaagaaagtcgatcaggctgttgccaagggcattctgcacaagaatacggccgctcatcgcaagagcgccatgaccctgaagctcaacaagatcggctgatcatatcgggccaaaaggacatccgttcggatgtccttttttgttttctggccagggggcttttcccgattctggcccttttcttttccgcagggcgtgttataatcgtccgtaggatcagaattccgctgaagaggtgactgccatgccgctgttcgacacccacgcccactacaacgacgacgcctttgaccagaaccggaaggggctgctggacgccctgccggacgccggagtgggggctgtggtgatccccggggtggacgtggagagctcccgctccgccctggccctggcggagagccgcccctggctgttcgccgccgcaggcatccatccggaggactgcgccggctgcacggccgcggatttttccgccatccgggacctgtgccgggagaaaaaagtggtcgccatcggagagatcggcttggactactactgggcggagaatccgccaaaggaattccagcagatggtgttccgccgccagctggagctggcgctggagctggagctgccggtgatcgtccacgaccgggaggcccacggagacagcctggagatcgtaaaggagttccccggggtgcggggcgtattccactgcttctccggcagtcccgaaatggcggaggagctgctgaagcggggctggtatctgggctttgacggtccggtgacctacaaaaacgctcgccgggcgccggaggtcgtggccgtcacgcccctggaccggatcgtggtggagacggacgcgccctacatgagcccggtgcccaaccggggcaggcggaacgacagccggaatctcccctacattgtggaaaaactggcggagtggaagggcatctccccggaggagatggcggcgcacacctggaacaatggcctgcggctgtttgggctggaggggaaggtatgaaaaaagcgtttctgatggtcctggcctgcctgttgctggcgggctgcggcgcgccgtcagagacagtgacgccaacggactcctggccggattccgctctggcggaaaccaatgaagcggctgctgaatccccgccggagcctatttcaaccgcgcctgccgaatccccgccggcaaccgccccggcggaacccctctccgcccccgccgtggtaacggcggggcaggcgccggaggaaccctatgatttgcccacggaggtgatcgggctgaaggactggatcggtgaaagccgctggaaccatgacccggtgggccttttggcagaactgccggagcgggagctctccctctacggcgtgacaaagtggcttgacagctcagccctgctgcgctggggtgacagtctggcggagttttcctggtccttcggcggcccgttgattgtggagccgcagctttggtgctgggatgtggactccgacgggcaggaggaggtcgttgtcatcaatcatgtggacagcggcaccgggacttctattgaggagcttcacgtggtcaaaaaagacggggacggcaccttgacggactactgctttccggagtcactgtggcaggaggacctctccggcctgctgtcggtggtgtcggacggggaccggacctacaccgtcttgggcgcggatctggtggacctcacagacgagatccagacacagtttccggacctcaatccggccatgatcgaggacacctctaccggaagatgggccaatttttccgtgcaatccggtacggatgggaacggcagcgatcttttctttacgggttctgcgatgttggaggggagggaaatcccctatgactggtatgcggcggagattaccgctgccatctcctatgaaaacggcatcttcacgctgtcggactttcatctgaacagcttatcctgattacgcaaggagcgatatttatggaaaagggctttaccatcacctatgaatacggggacaacctgtatgtgaaccccaccaaccggtgcaacttcaactgcgcgttctgcctgcggcacaaccagggttccggcggcagcatctacacccataacctgtggctaaagcgggagcccacgaaggaggagatcctttcctccatcgagagccacgacctctcccaatacaagcagctggtgttcgtgggcttcggtgagcctacctaccggttcgatgacatctgctgggtcatcgaccagatgaaggcccacggcaccaagatcttcacccggatggacaccaacggcaccggttccctcatcaacggccgggacatcgccccggagttcgcgggccggttcgatatggtgtctgtctccctgaacaccgacacggcggagaagtacaacgccctgtgccacccccagcaggaaaacgcctaccaggccatgaaggacttcacgagagaggtcctcaagtatgtgcccaccgtgatgatgaccgtggtggacaccatcccgaaagaggagatcgagaactgccggaagatctgcgaggaggagatcggcgccacctaccgggtgcgggagtacattgcggactgacaaatgcagatatgaagagacgcccgcaggggcgtctctttttcctgagcttatgtatggaataccacggacttcacgatgatgctgacgccgcccaggaggaagaggacgatggcgcccttttggagcttttcctcttccagccggggccccagccacgccgccaggcccatggccagcaccgccgcgggaacagacgccagggcgaacagcagcaccgggccggtgaacaggtcggtgactagataagtcactacccgcaccgcattctccccaaagaagagaaagcacatgctccccttgaactcgctgtaatctctggctgttcgctggaggtaggccacgatgaacatgttgatgccgaagaggcccgcgcacacgccggagaacgcggacaccgccagccgcagccagggccggtccttccggtccggcttcaccggccgcagggagcgggtggccatctccagccctaaaagcaccacgacgacgcccagcacggttttgatgacccagggcatggaaaagcgcagcagcagcgtgccggggatcacgccgcagaagttggccgccagcaacggcaggatcttccgccactggaagctgtgccggtttttccaggtgatccaggcgttcaccgggcagtccagcagcagcgtacccggggtgatgaccacattgtccaggcccatggacaaaatcggcgcggagatcagggggttgccgaagccgatcagccctttgaccagataggccagcagctgcgcggcaaagataaacagtgcggttgaaagcgtcattgtatgttccctcccagattttcacccctcattatataccacattttcagcggaaaggaaacggcattctgcctccggcggaaaaaatggactccctgttccaggtttgtgtcggtagaggcatccccggcaaatcgataaacgatttgccggggaattccaataagtgcagatttaaatataaagataccatatcgtcatgattgcaaaatccgcaaacatatggataacccatgaatgatagatattttcatttttgctatctacatagtcaaaaagcagcccgccaatcgccaatcctattaaagccaaaagcaacatcaacggcggaaatgacattccaatcattgcaatatgataaactgcaaacatgcctgaactgaatatatatgctatttttcgggctgtgtatttggataatctgataaatgcaacgaaacgaaagaaaaattcctccagaaaggaattgcaaaaggaaatatagagagccaccccaataaagctgccgctgttgactttttgatccgctgaaagcgactgaaccaacgacgcatagtcgaagaagttttttgtcaaagtatacgcacccagaatcaccgcatagataaaagagcccagcacaaataatttcatcatgcccctcttgtcgattttaaagaattcatccagtaattttgtatgggttatttttgcatataccaatggcaataataaaaataccgcgactttaagcgcggatttgacaatatatgccggttcaatgattgtttcaatgagtgccataaaaacacaacatattataacaagaacaataatacccgacgctttttctttattcatagccatcagtattatctgcctcccaaatataaatctgctgcttttatattgcctatgtctcatttttaccattatagaatagaaaaaagttttgcgcaaggcagcaggtgaattcgccggggttgtgcgctatcattccactatctagagccggagcccagcaggcggttttgcttgcatttcccgggaaaaaggcgtatgataagaggcgagaaaatggggagcccgctggcgcgggctgagaggaggccagccaggtcttgaccctttacctgatgtggatcatgccaacgtagggaaatcatgaggcgcacagccgcggacgaccgttcttggtatgtccgcggtttttttgacagagaggatggagtgatatgaagatcgaccccaagcggctgcggctgtatgccgtgacggaccgggcctggactcatgacgcggagggcctgctccgtcaggtggcggcagccgtcgacggcggggcgggcatcgtccagctgcgggaaaagcacatgggacaggcggatttcctggcggaggcggagcggttcgtggccctgtgccgggaaaagggcgctgtcagcatcatcaacgacaatgtggagatcgccgcccagaccggggcggacggcgttcatgtgggccaggaggatctggaggcgggccggactagggagctgctggggccggacaagctgatcggcgtttccgcccactccgtggaagaggccctggccgcccaggcggcgggggcggactacctgggcgtgggcgcggctttcgtcaccggcaccaagacggacgccaagcccatctcccgggagaccatccgggccatcacggcggcggtggacatcccggtggtggccatcggcggcatcagccatgacaatattctggagttgaagaactgcggcctggacggcgtggcggtggtctccgccctgttcgcccaagccgacgtgaaggcggcggcggaggagctgctgcggctctcggaggagatcgcccgatgaacatccggggcgccatctttgacctggacgggaccctgacggactccatgtacatctggcagaaggccccggtggatctgatgcgccggtacggcggtgacccgccggaggatctggcccgggacctgaaggagatgggccgccgggaggcggcggagtacctgcgaagccgcttctccctctccaccacgccggaggagctgatggacaccctcaacgatctggtgacggaggagtaccggtcccgggtgcccttgaagcccggggcggaccggctgctggcccggctggcggattccggcatctcctgctgcatcgccaccgccagcgaggcgttccaggcccgctccgccatggaacggctgggactgtggccgcacttccgcttcgccgtcagctgtgtccagtacggcggcaagacccggccggacatctatctggaggccgcccgccgtctggggaccgctccggcggagacggtggtgtttgaggatgcccttcacgctgccaggaccgcccacgaggcaggcttccgggtctgcggcgtctgggacgcctctgccgaagaggatcaggccgcgctgaaagccctggcggattggtacgtgcgggacctgggcgactgggtcccgtaagggacggggaaccgcggccagcgggccgcttccagcggcggatcgggggcaccaccttccgccgcttgataaaacttcaatgcaaagaagcatcaggaaaggaagcatcgatatgaagacagcattgacgatcgctgggaccgatcccagcggaggcgccggtatccaggcagatatcaagaccatgaccgccaacggcgtgttcgccacctgtgcggtgacggctctggtggcccagaacactaccggcgtcaagagcatcgtggagtgtacgccggactttctggcggaggagctggactgcgtgttcacagatatcttccccgacgcggtgaagaccggcatggtctccagcattccgctgatccgggtgatcgcggccaagctgaaggagtatggggccaaaaatctggtggtggacccggtgatggtggccacctccggggaccggctcatcacggaggacgcggtctccgccctgaaggagctcctgctgcccctggccacggtactgacccccaacatccctgaggcggagatcctctccggcatgacgatccgcagcgccgcagacatggaggcggcggcccgggccatcagcgagcagtacggctgcgccgtgctgtgcaagggcggccaccagatcaacgacgccgatgacctgctgtggcgctgcggcagcggcaagtggttccacggaaagcggatcaacaaccccaacacccacggcaccggctgcaccctgtctagcgccatcgcctccaatctggcgaagggctttgacctggacacggcggtggagcgggccaaggcttacatctccggcgctctgggggccatgctggacttgggacgcggttccggccccatgaatcacatgttcgacctgaagagcatctactgtacggaaaaggcagattgaccagtttgcagacaacagggggacagcggttttatccgctgtcctcctgttgtttttgcgcagaaaaacggcggttccgatggcgggatctatttggaatcaccagactgaacaaaatgatttcaggtatttttaaggtttaaaacgagctaaatatactgcaaaaataataaaaacaaaattttttaaagtattttttcaggttgattttagctttccatgatacctttggaccagaacccttcccggagggggaggtacggaaaggattggcacggtatgagcgaaaaaggactggagcgggagacggaaggaatctccgtgggggagcgggagcccgtcgtagcagattcctctcccaaagggggccgtctccgcagcagctggaaaaagctgtggaaggggcggaaacgaaaggcgctggcgctgcttctggtggtggccattgcaggcggcgtggtgatctggaggggccgcggacagacggcctccgctgcgacgacgtatcaggaggcggcggtggagcgccgctctatcactaattccctctcctccagcggcacgctggagccagcggactcctacaccgtcaatacgctggtctccggcgagatcctcagcgatacctttgaaaagggcgaccaggtggaggagggccagctgctctatactattgattcctccaacgcggccagcagccagacccaggcgcagaacagctactcccaggcccagacctcctatgagcaggcggtgaaggccaagtatccccaggcggacctgagcggcaccgtcagcgaggtgtatgtgaacgagggggacagcgtcagcgcaggcacacagcttctgaagatcgtggcggatgagaacatctacatcgacttctacttcacctacgcggacagcggcgacttctacatcggccagaccgccacggtctttatcgacggctttgccgggaccctcaccggaacggttgccgcggtgtccagttcctccgcggcggtctccaccggcgtacccctgactaccgtccgggtacggctcgccaacccgggccttgtgacatccgactacaccgccagcgccgtcatcggcagctactccagctacggccaggcgtccatcaaggtgggggccagcagcgtcatcacggcagaggcgtccggcaaagttgcaggtttcaactggctggtgggcgataccatctccagcggcgaccggatctgcaccatcaccggtgacagcgtggacaaccagattgaaagcgcccgcatcagtgtcagcaacgcctccaccagcctggaaaatgcccgggacaatctggaggactactccgtcactgcgcccatctccggcaccgtggtcaccaagaacgccaaggcgggggacaacattgagggcggctccggcagcaccctctgcgtcatctatgacctgagttatctggagatgaccatgtccatcgacgagttggacatcagctctgtggaggtgggccaggaggtccggatcaccgccgatgccgtggaggggaagacctacaccggcgtggtgacggaggtgtccgtggcgggcaccacctccggcggcatcaccacgtaccccgtcaccgtccgcatcgacgagaccgacggcctgctgcctgggatgaatgtggacgcggagatcgtgatctcctcggcggatgacgtgctggccatcccaagcgccgccgtgagccgcggggacatggtgctggtcaccgcgaattctcccagtgctgtgaatgccctggaccaggaggccccggagggctacgtctacgtgccggtggaaaccggcgtcagcgacaacagctacattgaggtcctctccggcctccaggagggggacacagtggcctatctccaggcggctggctccgccagctccggcgatatgacgttcgtcatgccgagcggggccatgtcctccataccgatgggcgacatgcccagcgggatgccctccggcggcggaatgcccagcggcgggccgggaggcttctgatgggcactttgatcgaatttcgggaggtctgcaagtattaccagatgggcgacaccactgtgaaggcggcggaccacatctccttccagatccggaagggggagttcgtggccatcgtgggccagtccggctccggcaagtccacctgtatgaacatcatcggctgcctggacgtgcccacctccggcacgtacctgctggacggcagggatgtgggtcagatggataaggaccagctggccgccatccggaacaagatgctgggcttcatcttccagcagtacaacctgctgcccaagctgacgctccaggagaacgtggaggtgccgctgatgtacgccggcatccccaagccggagcggcacgagcgatcccggatcgcgctggagatggtgggtcttggcgacaagctgcgcaataagcccagccagctctccggcggccagcagcagcgggcgtccattgcccgggctctggcaggggacccggcggtgatcctggccgacgagcccaccggcgccctggactcccacaccgggcgggaggtgctgaccatgctgcagcagctccatgccgcgggcaacacggtggtgctcatcacccacgacaactccatcgctgtccaggcccagcggatcatccggctggaggacggccacgtgatctacgacggcgatgccggtgcgcctgaggcggtagtgacgcccaaccttgccggaagggggatggcgggatgagcttgatcgagaccttccagatggcggtgcagaatattctcagcagcaagatgcggaccttcctcactatgctgggcatcatcatcggcgtgtgcgcggtcatcgtcatcgtgggcctgggcaacgggatgcagggctatattgaggacagctttgccgacatgggcaccgactctctgacagtgatggtgatgggccgcggctcctcccgcagcgtgtcggagggcgagatgtaccagctggtggcggacaacagcgatgtgttcaagcagatctcccccacggtcaccatgagcggctcggtgaagatcggcagcagcactctttccgccacctccgtcaccggcgtcagcgaggattacttctccatgaaggggtatgaggtcgcccagggccgggggctccagtacacggacatgaccggccggaaaaaggtctgcatcgtcgggcagtatctgaatcaggtctattacggcgggaatgccgtgggtcagacgctgcggatcaatggcaactcgtttaccatcgtaggtgttatgggaatggagggcacagagctggaagagggcggcacggacgactgcgtgttcctcccctactccaccgccgcccgcctcagcttcaccggcaccatctccagttacaccatcactgtccaggacacggaccagatctcccaggccaaaaccaccctggagaacgccctctatgagatttttgaggacgacgatgcctataccgtgggcagcatggcggagatggtggaggagatgaactccatggtgaacatggtgatctacattctggcgggcatcgctgccatctctctggtggtgggcggcatcggcatcatgaacatcatgctggtgtcggttacggagcggaccagagagatcggcatccgcaaggcgcttggggcccgggagggcgccatcatgcgccagttcgtcatcgaggcggctaccacctcctctctgggcggcgtactggggatcgccctgggcttcggcctatccgcggcggccacggtggtcatcgccaatgtcatgccggacacccccatcaccgtcagccccagcattgcggcgatcctggtggccttcggtgtctccgcgggcatcggcatcgccttcggatacctccccgccaaaaaggccgcggtgctgaaccccatcgatgcgctgcggtatgattgagacgccatccgcatccgcccttcccggcggcgggtccccatccggggacccgccgccgtttttcttgtcagtcgggcccggccgtggtacaatggccgcgaaacaaccggtcttccggccggagagaggttctgcgaaaagaggagactgccatgagggagatcagaaagaagcgtgcggtggctgtggaagtccgccgggagaggaagtggttgatgcagtaaaaaggaaacaggaggagacatcatgaatcagaccatccgcggcatggggcttccggaccccgacgcggtttttccaaacgaatacggcacatcctgctatatcaaaaatgtggtgacggccccgaacatccagatcggggattacacctactacgacgatccggtggaccctgcggggtttgaacagaacaacgtcctgttcaactatccggagttcggggaccggctcattatcggcaagttctgctccatcgccgccgggacccagttcatcatgggcccggccaaccaccggaccagcagcgtcagcacctaccccttccaggtgttcggcggggcatgggctgaccaagcgccgcctcacctgggccagttgccccgaaagggggacatcatggtgggcaacgacgtgtggatcggccgggagagcgtgatcctgccgggggtccacatcggcgacggcgccatcattgcggcccgctccgtagtggcgaaggatgtgcccgcctataccgtggcgggcggcaatccggtccgcgtgctgaagcagcggttcccagaggatctggtccagttgctcctggcatggcggtggtgggacctgcccccggcggagttggcggaggccgtgccgctgctgtgcgacccggatctggacgcggtgcggacggacctgcgccgtcgcctgggaatggcggagtgagtggctgtatgcaaaaaagtcccggccctttttagggccgggacttctgcttttttatgaagcgccgtctttcttgggctcgatcagataagacggcaggctccgctggcagccgtttttctcataaaacgcttccgccccggctgggcgccgaaatacagcagcgtgggggtatgggccgcagccagccgcagcagccggcttccgatgccctgccgctgatatgccggcaacaccagcagctccgtgatggtgccgaaaaagcagccgtctgtgaggactcgcaggcagcccgccagctggccgccgtcccaggcagtgaagttcatcgtttttgacagcgcggcgcgggtctgctccagattgtacgctcccggccagacctgctggacaaagtcgaggaaggtctctccggaaaggctccggtcgtccacacgatactccatggcagcatcctccaatcccgtcacgcctccgccatctcccgcatcagggcgatctcccgggcatagccgggcaggtcgttgggggtctccagacagaagggaagatccttcagcgccgggtggcggacgatccgccccagcgcctccagaccgatggtcccctcccccagacaggcgtggcggtccttgcggctgccggggggattcttgctgtcgttcaaatgaatcgccttcagccgccagaggccgatgatgctgtcaaattctgtcagcacgccgtccaggtcgtggacgatgtcgtatcctccgtcggacacgtggcaggtgtccaggcagacgcccaccttgccggagagctccacccggtccagaatggcccgcagctcctcaaaacggccgcctacttcgctgcccttgcctgccatggtctccagcagaacggtggtggcctgatcgggccgcaggatggcgttgagtccgtcggcaatgagagcgatgccggtctcgcttccctgccccacatggctgccgggatggaagttgtaatactgtcctggcacatgctccagcctagccaggtcgtccgccatggtctcccgggcgaatatccggttcttctcctccgcgccgcagaggttcaaagtatagggagcgtgggcgacaatggggccaaagccgtgccgggccagcaggtcccgcagggctgcagcgtccgccgggtccaggtccttggcccggctgcccctgggattgcgggtgaaaaattgaaaggtgttggcccccagctccagcgcctggcggcccatggccgcaaagcccttggaggaggacagatggcagccgatatacagcatggccgcgcctccttctctcggtctgtactgctctgcatccgccggaaggcggaaggagattatattttatcataccacatggacactgcctatgcacgggcaaaagcaacaaaaagcggggtctgccggccgaaaccggtgaccccgctgagacactgccggacgctggtaaagcggcggccccgtccggcgggggccttatatgtttcgggagagcggatcggcttcatcgtctgtgatgaaaagttcctccgccttctgctgcgcatcgatcagccgggcctggagccggcgcagggattcctccgcatcggtgatggcgttgaagagcaacagatattccttggagaccttctgcatttggtattcatcctttctaaaccgccacaagatctggggactgcccttatcatacacaaaggccgggcgaaattctgtctgaatctgtcgagatacccaaggttttgcaaaaaattcaaaaaccaacacaaaatagcaggaatttccgaaaaaacgaaaaaaatccagggccttttgccggaaaaaatggaaatggcaaaaaaaagcggtccgcgtcaggcgcggaccgctccggaattcaagtcaggtttcgggctgctccagctcccgcaggccggcgatgtcacccaccggcagggagaacaccagggactgagcggcgctctggatgcccgccttggccatgatggccttcataatgggcttcttcgcctcgctccgggccaggatgaagaccatctcctgctccgacgcgatggacacgccgaaaaacttccgcaccaggtctgtgccggtgcccttggcgtggatcaccgtgccgccggtggcgcctgcctcccgggcggcgtccatcaccaggtcggtggacccctggttggcaatgaccacgatcagatcgtgggcaatctcccgttccatagcagtttctccctcctgttcatgcagcagatattccttggcggtggatccgccgatgctgttcaccggcacagtcatcaaaacgccctggccgggcacatccagccacaggtcacgggccgcctggcgcaccagccgggggaccggggggacacgcagaacagcacggccttctccgtggcctccaggcccagaaagtccagcacctccgtggtggcggtgccctgacccagagctgtcagcaccagcgagatcccgtgggtccggaaccaggcggcgaactgctctgcccggctgcggtcagtgatggtgatgaacaaatcgacgccctgcatggcggtctctcctctctttacgatgtcggacggactgctcacagctcgatgatctcctcgtccaccggggcgggaggcgtctcctgagcggctctcttcatcttgagctgatacaaaaggcccagcatctggatggtcagcagcggcgtcatagccaccatagccaccacgccgaaggcgtccgtcaccacattgccgcccaaggcctcgcaggcgccctgagcaaagggcagcaggaaggtggccgtcataggcccggaggccacgccgccggagtcaaaggcaatggcagtaaagatcttggggacgaaaaaggacatgacaatggcggccagataccccggcaccaccagccagaaaatggaaatcccggtcatcacccgcatcatggccagaccgatggaaaccgccacgccgatggagaggctggtgctcatggccttgccgggaatggcgccggaggtgatctcctccacctgcttgttcagaacatggaccgcaggctccgcctggacgatgaaccagcccatcagcattccgatgggaatcaggatccagttgaaggacaggccggcgatctggcggctgaggtagctggccgccggcatgaagcccacgttggcgcccgtaagaaacaggaccaaacccacataagtatacaggatgccgatgacaattttcaatacttttttcttctttaatttcagggaaaccgcctgaaaaacggcgaagaacagtgcgatgggggccagacacaccgccacttcgctgagatacgccggaagttccacctgaaacaggtgccacagagcccggctgtctgtcacggaggggatttccaccggggtgtagacgcccgcgcccgggtagatcagggccagcaccatcaccgccaggatggggccgacagaacagagagccaccaagccgaagctgtcctgggcggcattctcgtcgctgcggatggaggccacgcccacgcccagggccatgataaagggcacggtcatgggacccgtggtgacgccgccggagtcgaaggcgatggccaggaagtcctccggtacaaagagggccagcgcaaacacgaggatgtagaacacgatcagcatccggttcaggggaatgcggaacaggatgcgcagcatggcgatcaccagaaaaacgcccacgcccacggccacagcgcccaccagcgtggcgttgggcacaccgggcacctgctgggccagcacctggagatccggctccgacacggtgacgatgacgccgatcagaaagccgacagccgccacaacccagagctttctggagcgggtcatggcggcgcccacccgttctccgatgggggtcatggcggtgtcagcgcccagggaaaacaggccgatgcccagaatcaccatcaccgcgccgatcagaaaggccagcagcgtctcggtggggatgggcgcaacagtaaagctgaggatcagcacgatcaccgtaatggggaccacggaggccaaggcttcccggagcttttcccagaggatggttttattccgccccaatcgttcctgccattgctctcgtctcttccacggcaatctcatcacctctccaaaattcatacaatttatatagatatgattataataacataaataggccgcccacagtgacgaaaaagcagaaatttacaaaatctttataagcggagcggtgattcccttttttcccgaactgtgctatgctgtaccatatcaccttcacaggagtgcgcaggatgaagaagagtccttacgacagagagcggttttttgaaaaatacagccagatggaccgctcccgcctgggactggcgggcgccggggagtgggagtccttggagcccctgctgccggacttcgccgggaagcgggtgctggatctgggctgcggctacggctggcactgcatctatgcggcggaacacggcgcggcggctgtcaccggcgtggacctgtcggagaaaatgctggccgtggcccgggaaaagaccacggctccgcaggtgacctatatccggggggatatggcggagaccccattcccgccggagagctttgacgtggtcctcagttccctggccatccactatctgccttcctttacagactttttggagcgggtgcggcagtgcctgtcacccggcggcgactttgtcttctctgtggagcaccccattttcactgctgccggtccccaggagtggtactacggcccggacggcacccccctccacttccctgtggaccggtatttcgaggagggacggcgcaccgcccgctttctgggggaggatgtgaccaagtaccaccgcaccctcaccacctatctggacggcctgcttaccggcggattccagctgctgcgggtggtggagcctcagccgccggcgcggatgctgggccagccgggaatgcgggacgagctccgccgccccatgatgctgctggtctccgcccggaagcggacggcgtggccgcacggaaaaccggggcggcgcgacggccccggatgaaaaactgctggaagatcatgaatacacagaaaggaaggactgctccatgaaaacaggtctggtgctggagggcggcgcgctgcggacgatcttctcctccggcgtgtgcgacgcttttttgaacgagaaactgcccatgccggactacaccatcggcgtctcggccgggattgcctacggcgtcagctacctctcccggcagaagcggcggaatctccagctgctgatgcactacgccaatgaccggcggtacatgggctgggggaatttctttgatccccggaatcgcagctacttcgggctgaagttcgcctacgacaccatccccaacgagctggtgccctttgattacgacaccttcgaggcgtatcccggtcaggtggaggcggtggtcaccaacctgcagaccggccgggccgagtaccgggaggtcccccggcgggacgccagcttcctcctgctccaggccacatgcgccatgcccgtgctgttccagcccatccggctggatgacggcgccccctatctggacgggggctgctccgacgccattccctggaagcgggcgctggcggtgggctgcgaccgggtggtggttgtcctgacccgggagcggagctatcggaaggagccggagcagctgatgcccctgttccggcgggtgtaccgcaaataccccgtctttctggaaggactgcggacccgggcggagcgctataaccaatgccgggaggagctgtttgctctggagcaggagggccgggtgttggtgatcgcgccggcgaacacccggggcttctcccgcacggagcgggaccggcagaagatcctggccctgtggcaggacggcttcttcgccggccgccgggctgcggaggcggtgcgggacttctggacgcgggagacaccttccgctgggacaccggaatagcagcagaccgccgcccatctttcagtgggcggcggtttcctcttggcggaagtggttttgcacaagaaatccgtactgctttttgcgttttaccatatttttacgcaaattttacaaaatcttagaaatcctctttccagcgtgccgctttgcatatataatgttggagcgcagtatacatgacagaatcggaccggccgtgccagacggtctggaatactgggaaaggaaagcgcagttatggacattttctccgtctttaccctctgcggcggcctggcgttcttcttgtacggcatgaccgtcatgtccaagagcctggaaaagatggccggcggcaagctggagcggatgctcaagcgcatgacctccagccccttcaagagcttgctgctgggggcgggcatcaccatcgccatccagtcctcctccgccatgacggtgatgctggtgggcctggtgaactccggcgtcatggagttgagacagaccatcggcatcatcatgggctccaacatcggcaccaccctgacggcgtggattctgtctctcaccggcatcgagagtgagaacgtctttgtgaacctgctgaagccggagaacttctctcccctgatcgctctggcgggtatcctgctgatcatgggctccaagcgccagcggcgccgggacgtggggcgcatcatgatgggctttgccattttgatgtacggcatggagctgatgagcggcgccgtcagccctctggcggagatgccccagtttgccgggctgctcaccgcctttgaaaatcccctgctgggtgtgttggtgggcgcggtgttcaccgggattatccagtcatccgctgcctctgtcgccattctgcaggccctggccatgaccggctccatcacctacggcatggccatccccatcattatggggcagaacatcggcacctgcgtcaccgccctcatcagctccatcggcgtcaaccgcaacgccaagcgagtggcggtggtccacatctccttcaacgtcatcggcaccgccgtgtgcctgatcctcttctacggcggcgacatgatcctccacttcaccttcctgaatcaggccgtgggggccgtgggcatcgccttctgccacaccgcctttaacgtgttcaccacgatcctactcctgcccttctcccgccagctggaaaagctggcgcggagactggtgcggaccgaggacacccgcgagagcttcgccttcctggatcccctgctgctgcggacccccggcgcggcagtcagcgaaagcgtcgccatggcaggccgcatgggacaagccgcccgggagaacatctgcctggcgacggaccagctctcccagtacagccgggagcgggagacccagatcctgcagaacgaggacaagctggacatttacgaggaccggctcagcagctacctggtggagatctcccagcacgggctgtccatgcaggatatgcgcacggtttcccgcttgctccacgccatcggggacttcgagcggatcggcgaccatgccgtgaacatccaggagtccgcccaggagctccacgacaaggagctccggttctctgacagcgcccgggaagagctgcaggtgctgctctccgcgctggatgacatcctggacctgaccatccgcagcttccaggcagcggacatggagaccgcccgccgggtggaacccctggaggagaccatcgaccagctgattgaggagatccgaagccgccatatccagcggctccaggcgggccagtgcaccatccagctgggctttgtgctcagcgacctgctgaccaacatcgagcgggcgtccgatcactgctccaacatcgccgtcagcgtcattgaggagtgctccggcggccccggccgccacgcctatctgcaggaggtgaaggccggcggcgccttcggcgaggacctgcggcgcgaccggaagaaataccatctccccgaggcatgacggaaagcggacaggctctgtgtctaccagacgcagggcctgttttttatcattcaggtatagccgtcccctgtcggagggaaaatacccctatctcaccgaaaacaggaggaatccgtatgtctgtggatctgaagaacagcgagaccctgaaaaacctcatgcgggcctttgcgggcgaaagccaggcccggaaccgctacacctttgccgcctccgtctgccgccagcagaagctgcatgtggtggaggcggtgttccgcttcactgcggaccaggagaaggagcacgcggagattttttacaaccacatgaaagagctggcgggccagaccgtggccatcgacggcacctatcccgtggacctgacgaacgatgtgaaggagctgctccgcaaggcgcagcacaacgagtatgaggagcacgacccggtatacaagaccttcggcgacgtggcccagcaggagggcttttccgctgtggcggcttccttccacaagatcgcagagatcgagcaggcccatggcaaccgcttcggcaggctggcggatctgctggaacagggaaagctgtttgtctccgatgtccagtgcgcctggatgtgcctgaactgcggttatatctttgagggggcggcagcccccaaggtctgccctgtgtgccagcacgaccagggctttttcgtgcggctggagatggcacccttcggggacgcggtgctgaaaaagtgaatcaggctcccaaggcggggaggccggaaaagcggcctccccgccctcttgcagtcggatctgaatattcactcttttattcatctgcaatatacatcgatgctggaaatattcacaaattttcggctgtttttccgggattgaaccggataaaatagagcactccaccaacaggggcaaataaatattcatttttgcacgaaaatctattgacaagagggagggaacgtgataaggtaaggcatgttccggcgggaggtgcttcctcccttggaaattcagagaaaaccgccccgcgaccgcgggagcatgaaaaagggagattgcgataccatgaagaagtttcttgcattgattctgacgctggccatggcgctgtccgtcacggcctgcggcggcagcgacgacactgcggatgacaccgccgacggcgagggctccggcacggaggagactgcggattacgcctccatgactgacgacgagctgaaggccgccatcaccactgtggagggcgggaagctcaccgtcgccaccagcccggacttcgccccctatgagttctacgccattgatgagaacggcgatccccagctggctggctttgatatggacctggcccagtatatcgccgactacctgggcctgtccctggagatcgttcccatggactttgacggcaccatcatggagctgcagaacggcaatgtggacttgggcatggccgggtactcccccgatcccaagcgtgccgacagcatggacttctctgacatttacatcaccggcggccagtctttcgtgtgcgtggagtccaacaaagacctgttcacctctttggaggatgccaacaatgccgactatcagatcggcgctcaggtgggttctatccaggcggatctggcgcatgagaacaccccggacgctgatatcatcgagctcgctaaggtgcccgatatcatcgccgagctggtgaccggcaagctggacggcgcctttatcgagaccatggtggccgagagctatgccacccagtatcccgagctgtgtctggtgctggaggtcccctatgacgccgaaggctctgtggtgggcgtcaccaagggcaacgccgccctgctggagggtgtgaaccgtgccatcgccgccgccaaggaggatggctccttcgatcagtatgtgcttacggccaacgagctggcttctggcgacatcatcgagggcctggtggacgaaaacggcgaggccgttcagtaagcttgtaaaactttcaattcctccctgcggctgcgcagggaggaattggccgctttctcatatattttggtaaagatagaaggaggaaccgcccgtgtttacagccgccggtttcgaaagaacttgggagtacatagaccttttcaaagagggcctgatttgtaccgtctccctctccctgctgaccgtgattttcggttttgtcctggcactgctcctggccatcatgcggctgtccaatgtgcggccgtttcgctttctgggtctgaccaaggacggccatctccgggaacagggcgtgctgatggtcctcagcagatttaaccccctcagcttcatcgccacggtttacgtggaagtcttccgtgccacccctatgctagttcagcttttcatgatctattatgtggtgttcggagatattgatctgccctctttcaagatctttggaaccattcgctttgaacggttcctcccgggcgtgattgccctgtccctgaactccggggcctatctttccgagatcatccgctccggtatccagtccatcgacggcggtcagacggaggcggcacggtccctgggactcagccaggtgcagaacatgcgattcgtgattctgccgcaggctatcaagaatatcctgcctgccatcgccaacgagttcgtcaccattatcaaggagtcttctatctgctataccatcggcgttcaggagatcatgtacgcggtttcctccatcaaaggtgcgacctaccgcattgcggaaccgcttgtggtggccgcctgtgtctacttctgcctgacgttccccaccagcaagatcatcgcttacttcgaaaggagaatgagccgtggcgaccggagataagctgatccaagtcaaggacctgaagaaatactacaaccggggcgccatcaaggccctggacggcgtcacggtggacattgaccggggcgacgtgatggtggtcatcggcccctctgggtccggcaagtccacgttcctccgcagcctgaacctgctggaggagcccaccggcggctccatcatcttcaatggggtggatatcacaaaaaagaagataaaaaatgcggagggcaaaacggtaaaggtggacatcgaccagcaccgccagaagatgggcatggtgttccagcacttcaacctgttccctcacatgaccatcatggacaacatgactctagcccccatccaggtgaagcacatggaccggggcgaggcggagaaaaaggccctggccctgttggaccgagtaggcctgcaggaccgtgcccgcgcctatcccatccagctctccggcggccagaagcagcggattgccattgtccgggcattgatgatggagccggaggttatgctctttgacgagcccacctccgccctggacccggagatggtgggcgaggtgctggaggtcatgaaggagctggcccaggagggcatgactatggtggtggtcacccacgagatgggctttgcccgggaggtgggcagccgggtcctcttcatggcagacggcaagctgctggaggagggctcccccgccgacattttcggaaatccccagcacccccggctccaggactttctcagcaaggtactgtaaggcagcctgagcccagtgccgcccgctgggcggcgggaccgggcaactgcggggcgcgcacatctgtgcgcgccctttttaacgggccggggcatccggcgcagaaaggagcatccccatgacagcagaaaagcaggcggccgtcgccgccatcgaaaaaaaagcagatctggtagcccaggtggcagatgagatctggtcctttgcggagttgtctctccaggaggagcagtctgccgacctgtactgccgagtgctggagcaggagggcttcaaggtggagcggggcatctgcaacatccccaccgccttctccgccttctacggcagcgggcggcccatcatcggcctgctggcggaatatgacgcgctctccggcctttcccagaagggcggcagcctgacgcgggaggagctggtctccggcggctgcggccacgggtgcgggcataacctgctgggcgccggggccatggccgccgctctgggagtgaaggcgtatctcgaggccgccaagatccccggcaccgtggtactgtatggctgccccggcgaggagggcggcgccgccaaggcatttatggcccgggatgggctatggtacggtctggatgcggccctcacctggcacccggacgacgccaacgaggtgcttaccggctcctccaactcctgcatccaaacccagtaccacttcaccggcgtggcggcccatgccgccggagacccggaccgtggccgcagcgccctggacgcggtggagctgatgaacgtgggcgtccagttcctgcgggagcacatgagtgacaaggctcgggtccactacgccatcaccgatgccggcggccggagtcccaacgtggtccagcccagggccagcgtgctgtacatggtccggtccaatcatgtggcggaggccgtggagctgcaggcccgggtggacaagatcgcccagggcgcagctctgatgactgagactacggtggagaagaaattcatcgacggcctggcggacaccgtcacgaaccacgccctggagcgggtcctctaccgaaattttgaggccctgggggtccccagttacacgccggaggagctggcctttgccgacagcctggccgggacctattccggcagtgaccgggcgccgggcgtgggcagccagtatgatctggactacgcagcggatgcccaggccaggcgggcccaggctggccacgccatgaaccgctttctgctgcccctgtaccaaggggacgccttccagcccggctccacggatgtgggcgacgtcagctggcagtgccctactgcacagatccacgtggccgcctggcccaacggctgccccggccatagctggcagaatgtctcctgcggccggacagacatcggccacaaggcggccctccatgccggcaaggtcctggcggcggccgccattgacctgctgacggacccggccctgctggaggaggcaaagacggagtttcagcgccggacggcggcaggctacacctgccctatccccgcggacgcggtacccaccatcgcagactgattaaaagggcgccccggtcaaagccggggcgcccttttgtcgaaacaaccaattattttttcaggttaccaaaaattttgtttgcttttggggaaatccatggtatcataagagcagaagcctcaagccccgacttccgcaccacagaacgcgcggagtttccgcccgaaaggagtcctgcccatggagtctcgctttgaccgccgggagctgctgtttcagccccggggaattccgcccctcggcacctcgctctccctggccctgcagcatctggtggccatgatcgtggggtgtgtcaccccgcctatcatcatcgccggagccatcggcctcagccaggaggagcaggtgctgctgatccaggcatccctggtgatgtccgccgtgtgcacattcctccagctgtatcccatcggcgggcggttcggctctggcctgccggtgatcctgggtgtcagctttgcctatgttcccagtatgcaggccatcgccgcctccggcggcggagtggcggccattgccggcgccatgatcgtgggcggcatcgtggctgtgctggtgggcgtgttcgtcaagaagatccgccggctgttcccgccggtcattaccggcacggtggtgttcaccattggcctctccctctaccctaccgccatcaactacatggccggcggcaccggcaacacctatgaatccgtggtggcgcaacaggggctgacggaggcgctggtatatggctcctggcagaactggctgatcgcggccctgacgctgactgtcgtgctggtgctgaaccacaaggccaagggcatctgcaagctggcttctatcctgatcgggatgctgttcggctatgcggtggcgctctgcttcggcatggtcagctttgccgacgtgggaaatgctgcctggttcgccctgccggagcccctacacttcggtctgaagttcgatccagcctcctgtgtggccatcgggctgttgtttgccatcaactccatccaggccatcggcgacttcaccgccaccaccgtgggcggcctggaccgggatcccacggaccaggagctccagggcggtatcatcgcctatggcaccagcaatatcctgacggcgctgatgggcggcctgcccacggctacctactcccaaaatgtgggcatcgtcaccaccaacaaggtggtgaaccggacggtgttcgccattgccgggggattcctgctgctggcgggcatctcccccaaatttgcggcgctgctgaccaccattccccagtgcgtgctggggggcgccacagtgacggtgttttccaccattgccatgacgggcatgaagctcatcgcctcccaggacctgacggcccggaacaccaccattgtgggtctctctgctgctctgggcgtggggatttcccaggcctccgaggccctcagccagttcccggaggcgttcaccatggtgttcggacagtctcccgtggtgatcgcaactatcatggcggtgctgctgaacctgattttgcccaaggagaaatgaaaaaacgaacgccggatgggtttccatccggcgtttttatttagggggcggggcgctcagatctcccggcggccctctagggcccgcatcagcgtggcgtcgtcggcgaactccagatgtccgcccacgggaatgccgtaggccaggcgggtcacccgcacgtcaaagggctttaagagcctggcgatatacatggctgtggcctccccctccgtatccggattggtggccatgatgacttccttcacctcgccgctggccacccgctccaccagggatttgatggccaggtcgtccggccccacgtggttcatgggagagatgacgccgtggagcacgtgataccggccgttgtactccctggcccgctctatggcggccacgtcccggggatccgccaccacgcagataacggagccatcccgcttgggggaggcgcagatgggacacagccccccggcggtgaagttttggcacaccgggcagcaggtgacgcttttcttggcgtccaggatggcgtcggcgaactccttggcctccgcctccggcaggcccagcacgtaaaaggccagccgctgggcagacttgccgccgatgcccggcaggcgggcaaactgctccaccagtttttcaagaggtgcggggaaatattccatggtctgatgctccttcaaagggttcgtatccggtctccggccgggtatgggaaaaagaggcgatcaccggggcagatcgatggcgaacagggccgccgtgccgccggtgtggacaaacagcaggtcgtcctgcccgtcaaaagctccctggcgcagcagctgcatcatgccggcaaaggccttcccggtgtagaccggatccagcaggatgccctccgtccgggccagctcctcgatatagggggtatcctccggattcggcagggcatagccggggcccatgtgctccaccatctgaaatgcattctcttccggctggaaggggcactccagcagtgctgcggcctcccctgccaggcgggggacgatcttgtcgaaggggccgctgtccacggcgatgccggtgaccttcacaccgggcagaaacagcccggctcccagcagcagcccagcggccgtgccgccggagccggtggcggagacgatgtgtcccagccgcacgcccgcagccatagcctggacggcgatctcccgggcgccgctcacgtagcccacggcgccgagggccgtggaggcgcccacgggaatatagcagcacttgtgccccgcctgctccagcgtgccgccgatccggtgcatctctgcatagatctcgtcataggaatccatgtccagcagacgcacctcggcgccgaagagctcgtccagcaccagattgccccggtgctccgtgacgccccggcgcttcagcagcaggatgcacttcatcccgagccgcgcggcgcaggcggcggtgagggccgcgtggttggactgggcgccgccggtggtgaataccgtgtcgcacccctggtccagggcctccgccagaacgaattccagcttgcggaccttgctgccgcccagggccacgccgcacaggtcatcccgcttgatccaaatgccccggccgtactgctcgctcagccggtccagccggtaaaacggggtgggaaacacgcccagccggaccctgggcagatcgtgcagattccgcatggcgcgcgccctcagccccgcagctccgcgatgcgggcggggatatcgtcagccttgtagacggcgctgccggccaccagcacattggcgccggcggcgatgcaggtcttgcaggtgacgggatccacgccgccgtccacctccagctcgcagccggggttcttctcatcgatccagcggcggatggcggagaccttgggcatcatatccgccatgaacttctggccgccgaagcccggctccaccgtcatcaccagcaccagttccacctcattcaggaagggtaggaccgtctccgcaggcgttttcggcttcagcaccacaccggcccgcttgcccttggcgtggatcctggcaatggcgtcgtggagcttttcctccgtgtcggactccacatggaccgtcaccaggtcggcgccggcgtcgcagaactgctccacataccggcccggctccacgatcatcaggtgaacatccaggggcagcgccgtggtggggcggatggatttcaccaccgggataccgatggtaatgttggggacgaacatgccgtccatcacatccacatggacgtaatcggcggtggagatgcgctggatatcccgctccagattggcaaaatccgcggagaggatggacggtgcgatttttatcatggaaagcccctcttttctttcattccggcggcagaccggacggaatcgggctgccgggccctgtggcgcgggaagaacccggcgcataggataccccgagcggcaggccgccccccagtctgcacttccgcgcagcgtccgcccctgggcggggcgccgccgcttttttgaatagggagccggtggagcgtacgctctgccggctctcagcttgcgtatataccgtattcagtgtagcagacttccggtgcaaaagcaacggtctcttgcccggacgagccgggaggccggccctgcaaaaaattccaaaagtgttgcataaaccacttctaaaatgagaatattctgataatctaataccagaatccaagagagaggcggtggaatcgtggaagagcagatcgactatgaggagcgggcatcgctgctgaaggccctgtccaaccccatccggctgcagatcgtccacggcctgctgatttccgggtgccacaatgtgggctgcatggaggcgtccaccggcatgtcccagtcctgcatctcccagcatctgcagaagctgcgggcggccaatgtggtgacggcggaacggtccggaaatgaggtatactatcaggtggcgtcccgggaggtggcctccctggtggccgacctgctgggagaggaggcggactcctatgtcctatgatgtgctggtgatcggcggcggccccgcggggctgtccgcgtccatcaacgtccgggcacgggggcgcagcgccctggtggtctctaatcccctggaggaaaatcctctctggcgggcggagaaggtggacaactacctgggcctgcccggcctgtccggcgcggagatgctggccgccatgcgccggcacgcggagcaggcgggggtggagtttctggcgggcaaggtgctgaacgccgtgcagatgccggacgcctggtatgtcagcgtggggccggatatgtacaacgccagggctgtggtgctggcggcgggcgtggcccgcgggaagaagtttgccggcgaggcggagcttctgggccggggcgtcagctactgcgccacctgcgacgggatgctctaccggggcaagccggtggcggtggtgggatacaccgacaccgcccggcaggaggcggagtttctccagaaaatcggctgctccgtgacctatttcgaccgccccaagcagtgcgagatccggggcgacggccgggtggagtccgtcacctgcgacggccggaccattccggcggagggcgtgttcatcctgcggcccaccatggcccccacggagctgttcccggggctggcggtggaacagggctatgtgacggtggaccggcgtatggccaccaacctccccggcctgtttgccgcgggagactgcaccggcggtccccttcaggtctccaaggccgcgggagatgggctgatcgccgggcagagtgcggcggcctgggcggcggctcaggagcgccgggaaaaacagagctgaacgtacaacatcaaatttgagtgtataaaggagacatgacgtatgggaatcaagcatttcaagactgcggaatttgacgccgccgtggcggcggcccccttggcgatggtggacttctgggccgactggtgcggcccctgtaagatgctctctccggtgatcgagtccctggcagaccagtacgagggtaaggtcctggtgggcaaggtgaacgtggatgaggagccggatctggcccggcggttcggagtcatgagcatccccacggtggtgttcctgaagaacggccaggaatttgaccggaaggtgggcgtgatgccgccccaggcgtttagcggcgtgctggacaccaacctgtgagctgccccgggcggtgcgcacagtccaaaggcgggaaatccgttaaagcaggccgggcctcttgaggcccggcctgcttctgcctgggcgcggcggcccagtccccgcgggggtggggaacttgccttccggtgcgcccccctttccttctgcggccagcaggggcagccccgccgcagggctgcccgcagcccattcgctggtgcggcaattcgggcttccgcttggtgccgtcctatcacaacggggcacagggattggggctgcaagggaaacgcacagctcccggaggccggtttcagaaaaccgtcggttttcgattcgccttttcacaagaaggggaaattcagctggaagacccggccgggaattacaggctgtgcgacttcaccgcgggcgcattcctagaccgggctgttttaacggtatactgggacccgcaccgcaagaccggcatgaaagcaggccctgtccatgtggacagggcctgctttcatgcttcgatgctgatggcgctgaccgggcagccgtcccgggcctcctgggccgcctccagctggccctccgggatgccgctgccgtgggccagcccgtcgtcgcccatgtggaatacctccgggcaggtgccggcgcacaggccgcagccgatgcagttctcatttactgttgcgttcatattggtcactcctattattccagaatatttccatcccggcccagtgtcaccacctgccagggaatgaacttgccgctctgccgcagggccgtctccgctgcccgctgcataccgccgcagcaggggacatccatccgcacgatggtcagctcccggatatcgttgcggcgaaggatctccgtcagcttttcggcatagtctccctcatccagcttggggcagccgatcagcgtgatgcggccccgcatgaaccgctggtggaagtccgcccgggcataagccgtgcagtccgccgcgatcagcagccgggcaccgttgaaccagggggcctccacaggcaccagcttgatctgcaccggccactgggccaggtgggacaccgcgccgtcctgcggcgcggaaacggcctgagccaccgccggacggagggtctgggccatactgccgggacagccgccggagggcggcgcctgccgcggcgcggtgcctttcagggcctccgccttctttgccaggacagctgcttcatcataggctgcggcctcccgctccacaaacgtgatggctccggtggggcaggtgggcaggcagtctcccagaccgtcgcagtagtcgtcccgcagcaggaccgccttgccgtccaccatgccgatggcaccctcgtgacaggctgcggcacaggcgccgcagccgttgcatttctcctgatcgatctcgatgatccttcttaccatagtgtgtctcctttttggggtttcaaacgttttgcttgctttctgagacctagtatcgtacaatgggataaaaaagtatgttgtttttacaacggaatggagaaaatggtatggaagtttctaccgcgcttcttctccggacgccgttgttccgcgggattccgcaggaggcgctgcctgcgctgctggagggcctgggcgcacggaagcgccgctgtggccggggtgaagtggtcctgcggcggggagagcgggcggaccggctggggctggtcctctccgggacgctgcatatcgtcaaggaggatttctgggggagccgcaccattgtgggcctcgcccggtccggagaggtgtttgcggaggcctatgcctgtctgggcggtgagccgctggaggtggccgtgctggcggtagcggatgcggaggtgctgtttctcaacagcgtacaggcgctgtcctgtgcccggccgggcgccgcggaattcacccggaacctgctgaccattctggcggggcggaatctgaccctcacccggaagattggccacatggcccgccgcaccacccgggacaagctgctcagttatctgtccgcccaggccatgcaggccggagggccggagtttgatatcccgttggaccgccaacagctggcagactatctggcggtggaccgcagcgccatgtctaccgcacttggaaagctccgggacgagggtgtgctgacgtttcaaaaaaaccatttccacctgcttcagcagatggagcagactgactgaggaggagagcgccatgctgacccgagtgccggattattatgaggcgtttcactgtctggcgggggcctgcccccacacctgctgcgaaaagtgggaggtggtggtggacgaggagaccgcccgccgctatcaggagacccctggctccctgggggagcggctgcgggaggcgctccagacggacgaggagggggatttctgcttcccctccggggcggccggtgcccctttctgaaccgagagaatctgtgcgagatccaccggatattgggagcagaggccacgtccctgacctgccggacccacccccggttcattgaggagtacggcccctttcgggaggtcagcctctgtgcctcctgcccggcagcctgtgacctgctgcttggctccaccgccccgctgtccttcctggaacgggagacggcggagccggaggaaccgggagacccgtggctctgcggcctcctgcccctgcgggagcggatgcttcgggagctggcggatcggcctcgtcccctgcaggagcggctggaggcatttttgctcctggctgcggaggcgcaaatcctgctggatgaggaccggacagaggaccttgcggctctggcagcggactggaagaagcgggagacggcggtaccgcccgggcctggcctgtttccacacgccctgcgggtgctgtccaagctggaggccctggacggggactggcgggagctcctgcgcagggcggaggaggcgccgcccgccgccgtgccggagacgctgctggagcggctgggcacatactttgcattccggtatctcctgaaggcggtcaacgacggcgacctgctggggcaggcgcagttctgcgtgctgatggtcctgacggcacagcgcctgacggcagtatgtggcttttgggaggctgtccgccgcctttgctgtgaagtggagcacagtgaagagaacctggaggcgctgcgcctggcgtttcttcgggatgcagctctctcccccggggcgtttttgtgccagatgcggagttgagcggctttgcccgcacctttgtgcattttgctcacggtaattgatttcgatttatggaaagcgtaaaaatacacaaaagcacttgacagcaaaagaaatctattgtacattatagacacaggaaaggagtgagtcccatgggctagttagctcagagattcccaatcatccctgcaccgttcggaatcgaggaattcctcaaaacgcgaaactccggaagaacccaaagacgaaacacacctcacgatgatgagccacacgagaatcgagttttggtagcaaccagagcagacgtctgcgtgtaccgatgttttatggattggcaaacccctgagttcccctgtttccccagcatccggacggtatctcaagaaagcaagaggtaatgcatattggaaactccgatccagaagtaggccccccgttcgtcgttggagcgagcggggggttgtgctgtatagagggcatccggcaaaaagcagggatgcggaagctgaaagcctgttggggcgccggagggcgcttttttgctgcgcagaagcaccgaaacagactgtgtgccgtctccggcggtacggtgacccggtccggcccgtgggccggatgcataaagctgccgggatctggcggagcgccccattcttatgtgcgttcacaccgcatgaatttttctgccctgaagggctgggaaagcggcagaacaccgggcggcccctcccctgccgcgtgctgcgggccctttcctctgcggaatgtgaaaaaagctcccgggccaaatggcccgggagcttctgcgtcgatcttacttgtggtccacagaggacatatagcgaatcagctccaccatcttgttggaatagccgcactcattgtcgtaccaggagacgaccttcacgaaggtgtcggtcagagcgatgccggcatccgcatcgaagatagaggtgcgggaatcgcccaggaagtcggaggacacaacgggctcgtcggtgtagcccagcacgcccttcagctcaccctcagaggcctccttcatggccttgcagatctcctcataggaggcgggcttcgccagcttggcggtcaggtccaccacggagacgtccagagtggggacgcgcatggacatgccggtcagcttgccgttcagctcggggatgaccttgcccacggccttggcggcgccggtggaggaggggatgatgttgccggtggcggcacggccgccgcgccagtccttcagggaggcgccgtccagcagcttctgggtgggggtgacggagtggacggtggtcatcaggccctccacgatgccgaacttgtcattcagcaccttggcgatgggggccaggcagttggtggtgcaggaggcgttggatacgaacgtcatatcagaggtgtacttgctgttgttgacgcccatgacgaacatgggcgtatcgtccttggaaggggcgcccatgaccacgtgcttggcgccagcgtcaatgtgaccctggcacagctccttggtcaggtgcttgccggtgcactcgcaaatatactccgcacccacggaagcccagggaatgtccttgacctccatagcggtaaagacaggatacttcttgccgttgaccaccagggcgccgtcctcggcggagacctcgccggggaacttgccatgcacgctgtcatacttcagcatgtaggccatatactcggggttcatgaagggatcgttcaggccgacgacctctacatcgtcatgagtcagggcggcgcggaagacgaggcggccaatgcggccgaagccattgatgccaatcttggttttcatatcggaaagactcctttcacaaaatcagacgcaccggcggcgcgccgtcaaaacgtttgcgtaaacgttttctaataatcgcacaagtatattatcatacggtcgacctttttgcaactgtcaattcagataacattttctgcggcaggttgtggataatccataagaaaaagggcatatttcacaatttttacacgaaacagggggaaaaggggcttgacgcggagggaaagctgtcctatactgaagtggctaattatttgcgtaaaccaataaaccattgcgcaaggaggctgtcccatgaaggtgaccatcagcgatgtggcgaagctggcgggagtgtccaccgccaccgtgtcccacaccatcaacaatacccggtatgtgtccaacgagacgaaggagaaggtctaccgggccatcgaggagctgggatacacaccggacgcttccgcccgcagtttccgcacgggaaagaaaaagatcatcggctttattgtgcccgatatcgccaataaattcttcgcaaccatgattgagtctgtggaaaaatatctctccgccaacggctaccagctcatcatcgccaatacccgggagaatatggaccgggaggagaccaatatccgcctgctgacggcgggactggtggacgggctgctggtggccagcaccatggacgatttccagcggttcgacgccctgatccccgcaggatttccggtggtgctggtggaccggatctttgagacaaagaagtactcctccgtctgcgtgtccaacttccagcccatctaccgcagtgtatgccggctggcgggaaagggcgaccagcggatcggcatcatcggcggcctcccccgcctctccagcacgcaggagcggatctccgcctatcggcaggctgtggcggactgtggcctgccggaggatgagcatttaatccaatatggcgactccctggagaacagcgcctgcgcctgtctggaccagctgctggagcgcaagtgcgacgccatcatcgtctgtcaggggctgatggcctcggagaccatcatctatctccaccagaagggcatccagctggcccaggacatcgacctggtgagctttgtggactatgactccgatgtgtacgccctgtacgccaatcagatggactccatcatccagccggtggaggacctggggcaggctgcgggcgagcagatcctcagacgggtggaggtgcccgacgcgccgatctttgaaaatgtgctcacatccacgtaccgcccctacaaccagcctcgggcctggtctcattcggaccgctgaactgaaaaaacgcgccgcagaagcggcgcgtttttcatgtcctggagacgttatccctggaagcgcaggtggaagcgggcgccgggatcaccggcaaagacaatcgttccatcctccggcaaggtgacggtggtgtcgccccacaggacggaggaggcagtcacctggccgtttccgtcatacacccagaaaccggaattctccggcacctgcacggtcatggtcttgccggcggcatcgccgacctgataccagcgggcatagccatccgcctgaatggtggtgtaggaggcgccggagccagtgaacagcgtgggcgctgcggccgcgtccatgtagaggctgcccttggcgttgatccagaggacgccgtcccgctcctccagctggtagtccacgccgtcccggctgcccacgccgggcacctggatctcagagcgggcggtggtctcgtccgcgatccgggcggcgccgatatagccggggatcgtttccggaacctccgcgaccgcggcggcgtccgccagcgccaggaaggtctgggagttgtatggctcgttcatgggcaggatacccaaggtggcgatgctgtcccaggcggcggctacctcaggagagagatcgttctccggcagcttcacggcggcgtagttggcgatgggcagcgcccccaggcccggcagaggggagacggcctgctggtacagataggtctggccgttgcgctctttcacaaaggagatgtaggacaacccggtggaatcccggaaggagccgtcgctgcaataggtgaaggtctgggcggggatcgaggtgggatagttcaggtaggacatggtcaaagtgccgtcggcctggatatccacctgatactgggcggaggtggagccgtagtacccggcgttttccagctgttccgcgggcatggcggcggactccgccgcgggcagggcctttacagtctggtccacggtgacgccctcctccgccagagcggcgatgaggatctgattggcggccagctggtcataggtggacacgccgccggagctgaccacagccgcggccatgtcatactccggcaggaccaccaggccggcgtggtagtacagggtgtcaccgcctttcaccagggcctggatgtcgctttggcagaagggataccactccatgttgtcccagcccaggccgtaggccagggagtccggctctccgctttcgggccacaggccccggctgtactccggataggccatggcgtccagagaggactggcgcagcagctccgtgccggtcagggcgccgccgaaggacgccagatcggaagccgtggcatagatgcctccggcaccgatggcgttcagggcatcctggggcagggcgcgggggtcggtgccccggtagatgggggccaaatcgttggcgtcaaagtccccgccgggagcaaaggtgcggtccaggtccagaggggccaggatatgttcgtccacatagtccatgaagtccatgtcagtgatggcctccaccaccagctccgccagggagaagccgtcgttgcagtagacgctgaaggcgccggggtccgccgccagccgctgggtggagagcttctccagcagggtgtcatgggcgcgtgtgctggcctcgccgaacagcatggcgtcagagaggccggtgcccaggatgccggaggagtggttcagcagcatccgaacggtgatgtccttgtaacgctcgtccgccattttgaagtccggcagataccgggtcaccggggcgtccagagacaccttgccgtcctccgccagctgcatcaccgccacggtggtgtagatcttgctgacggatccgatgccgtacagctcgtccccggtcatcaggcgattttcggaccgggagaaggtgccggtctggccggtgagaacgatctccccatcctgccacagggcatattgcaggctctgggcgccgccgtactgggcggcgtaggcggcggctgtgtccgctgtggtctgtaggtccgcggccgcagcttggggctccgccgccgcggcggggaccgccaggctcacggccaggaggagggccagaaccagggctctccagcgagtgtgaagtacgttcataacagttcctttcccgccccacagggcgtttgtgccggacgctccggcgagatgacagtgccaggatacaccttccccccaggggaaggtcaagtaaaaaatccggaaagatccggtccaacagacgttcccggggacggatacccgtccccggtgtctgccggaaacacaaaggcggtgttgagcgcaggactcaacaccgcctgatcttctggatcaaagcgcaacacaacgcccactccccgggttcgcacttgaaaaaagcgcaccccgccggtataatgggaaatacggtgcagtcagatgactgttgtgttgagtggtcatgacactcatcacagggacatagcgggtggccgcccgctatgccctgccgcaatttatgcttccgcattcagtttaaccgatggagaatggaaaatcaagggctttccagagtttctcgccatatagaaaacggcacggcaaccgccgtgccgctctttttatgtcttgctccgccctgccgccagcatgaacagcacgccgatgacgccgaagaccaggcacatccccagcatggcgtcggcgccgccccagtcgatggcgtaccccgccaggaagttgccgaacatggcccccaggccgttggaggcgatcatcataatggactggcccttcacctggtccaccggggagacgtttgcgttggcgtagtagaccgaggcgggggtgaacagcccgtaccccagcagctggacgggctgcaccagcaggagtccggagaggccgggggccagcaggaacagcaggggcttcaccgccatgaagcagatggacatccgcagggtccccgccgcgccgaagcggcggaacagcggcgtgaacagcagcgccgcgggcagctccgacgcccccatcagaaacagtgccagacccaggtgcccctcgtcgccgccccggtctgagacgaggttcaccatgaagctgacgatgggcataatggccgccagggtgaagaacaggctcaccagcgtcagggtgaaggggcggctgcttttcagaatgtacaatatggagtggggccgctctcccccgccttgggcctgcaaggcatctttgggaaaggcagggtacagggccaccaccgcgatcatcagcaccagcagcgccatgtgggtcagcagcaggctttctgttccgaagcgcaccgcctgctggccgcacgcaacgcaggccagggcataggacagagaccccagcccacggctgaggctgtacgacatgtccaccccggcggcgatgaactgcaccgccatggagtccagcagaggataggcgttcagctccagaatgcccagggtcaggaagatcagggcggtgccccagaagccggggcgggtggtgtagaataccacattcacccccagggccagcaccagacaggcgttcagcaggcgtttgatcggcacctccgggtggcggtccgcccagcctcccagcaacggctgagccaaaatgccggcaaagcagcgaatggaggcaaagatccccgcctccccgctggtaaagccccgccccagcagcagagaggtctggtagcccgcgaagatggcaaacatggcccagtagaccacgtggaccagcgtataggatacgttcagccgccgcagagaggggaattcggtcatacggtctcctttccgggaatcagcagacccagcaggggttcaaaatccacgccctcccgcataggcaggtcttccgccgcggtccgctccgcgcaggcacggacgaacgccgccgcctctccggcggcggaggagagggactccccccgcaccagggccccggtgaggacgctggagaacacgtccccggtgccgtggaactcatgggctacataggcggtctgaacggcctccgtcttcccggtgcgggcgtcgaagcagacggcgccggtccggccgggggccagagaggcgcccgtcagcaccacagaccgccgccctcccaggctcagccgctccgtgatctcccggaggcccgcctcgccggcgggcagcgtctcatagggctggcccagcagcagcgctgcctccgtcaggttgggggtgatgacgtccgccagctccgccagccgggccatgccgctgcacatggcggcggtgtaggtctggtagacccggccgtagtcccccatcaccgggtccaccaccaccacggtgtccggtccccggaaccggcagataaagttctccaccacgccgatctgccgctcactgcccaggaagccgctgtatacagcctggaatgtcaggcccaagctggcccagtggtccgccaccttggacatttcgtcggtcatgtccagaaaggtgaacccctcgaacccgccggtatgggtggagagaaatgccgtgggcagggggcagcactggacccccatggcggagagaataggaatggccacagtgagagaacaccggccgaagccggacatgtcatgaatggcagcaacgcgtggggtcatcatggtacgcttcctcttttcaatggttttgaacagactgcatttcattgtatcgtagattttcctattgttcaagaggaagagatgtgatatactgcaactatcccagcatcatctctgcgggtatggtggaattggcagacacgatggatttaggttccattgggcaaccgtgcaggttcaagtcctgttacccgcaccagctcgccgcaagcgtcatatcgcttgcggtgagctttttcatttcattgcagagcttatcgtgcgctcgttctgctgcttttcgattccaaactgaaccaacttcactgggcttcggtttgggtccgccgctttgcggcgattttatcttactcacgaggtaatatcgactccaaccggccctgccatcaaaaggggcatctttttgggatgtcccttttgacgggtttcgctgtccggagggatggctccgccctccgatgctctaaaatacgcgggtgaatgaatttgcattgcgctaggcatccgctttccgggaaaacacctgcccgccgcccgtgccgactggaagggcggtgctgaaaatgtggattttgaccgaaccgttcccgcccaaaaagaacgatatccagaggccgccggtttttgacgttcggcggccagagaacggctccaaacagccggtccccttctgtgcttccacggtcccgcagccactgccgtgccgctggccgcgccctgattgaaactaaaaaaaggagacgcgctgaaaagcgcgtctccttttacagcagagtttgaccgtggtgcatccggcacggcagggcggcggatcagacctccaaattccggccggtctcccggtcgaagacatgggccacgttcccgccgaaggtgaacggcagggcgctgccggtggcgggaatcggatgccccgccccctggagatccatggtctggaggatgacgatggtgtcccgcccgcaggcgtccacgtggagatggaccgcagagcccatcatctccgccacgtccacagtgccccgcaccgcctgggacgcatccccggccagggagatgtgctccggccggacgcccagcgtgatggggccgggctggacctgcttccgggccaggttcgcctgcttggcttcggagagttccacccgggcgttctccagaaccaccgcatagcggccgtcttccttcaccagctccgcatcaaagaagttcatctggggcgtgccgataaagcccgccacgaacaggttcgtgggatggtcgaacacctcctggggcgtgccgatctgctggatgacgccgtccttcatgatgacgatccggtcgcccagtgtcatggcctctgtctggtcgtgggtcacgtagatgaacgtggtgtcgatccgctggcgcagcttgatgatctccgcccgcatctggttgcgcagcttggcgtccaggttggagagcggctcgtccatcagcaggaccttgggctcccgcacgatggcccggccaatggccacccgctggcgctggccgccggagagggccttgggcttgcggtccagatactccgtgatgcccagaacctccgccgcctgatccacccgcttgcggatctcctccttggggtacttcttcagcttcagggggaaggccatgttctcccgcacagtcatgtgggggtacagagcgtagttctggaacaccatggcgatatcccggtccttgggtgccacatcgttcatcagcttgccgtcgatatacagttcgccgccgctgatctcctccaggccggcgaccatccgcagggtagtggacttgccgcagccggaggggcctaccagcacgatgaactccttgtccgcaatgttcaggctgaactcctgcactgccagcacgccctcatccgtaatctggaggttcgtcttcttctcctcagagccctttttcttcttggcgggttcctggtggggatagaccttcttgatgtttttcagaataacttctgccatgatatcaggctctggaaacagcgcctccgcagctgttccctcacggccggccggggccggtccgcctctgtggcaggtctccacgctgccgcaccgcgagccaggcggggttctcctccttttttcgtcccgctcccggcagaatgtggagtgccggagcggacggatatgtcgtatttgaccggggactcaatccgggatggacaggtatgtgccctccattgcgccgccggcgcctactgtgaacgtcagggcctgatggggggcgggactgcgccgtccggaccgggcgggcagtcggaaaagtacagccgtgcgccgctgtccgccatcatctgcaggatggccggatcggcgctgttgtagcggcggtcgctggatgcgcagcacaccaccgcccggggagcgatggcctggatctgttctgcagaaataccgtcccgctggccgtggtggcccaccttgaagaggtcggcccgcagggaggcggggtccagccctccatagcccatgtagttggtgtcgccggggagtaggatccgggtcccccggtactccagcaggaggatcaggctgtaattgttcatggccgcgtccagctggtccaggcgctgccagaaagcggacgggtccgcctcctcatacagtgcccggcacgaggacgccagcttctccgcctgtgcacgggaggggcccagcacccgaaccaagagatcccggcacagccggagctccattccggccagaggccggtggcgcgggcagctctgccccaggcagaggcggcggtagtcgttcagggcccggagaaacttgctccgggagggcgtcaggccctccgccggaatgtccagcgtccgcatggagcggcaaaactccgggggcagcgtctgccagagggcagcgggaggcagcttctccgccgcgggcagcaggccgcacaggtggtcctcatggacatgggtggctgccatcaggtcgatgtggtccacgccccgcagggagaggtactggtccaaggggatacggccggtggcgctgtcccggtactcttctgcttcggcgctgccgccgtcgatcaccatgacaaaggtgccgccggggaaggccgggtcgggacattccagcagggcggcctccccatagcccacgttgacgaatgtcagcttcagttcttccataggcgctcaacccatggcccgcttgatgtagaagctggacaggatcagcaccagcaatgtcatcacgatggcgccggcgctgccgaagccgaagtccagagacttgataccgtatgtatacaagaactgagtgatggtcgtggtggtgcccgccgggccaccgccggtgaggacgttcaccttctcgaacaggcggaaggtgtcgatggtccgcagcagggcgcacagggccaggctgcccttgatgttgggcagggtgatgtaccagaactgctggaagaagccggcgccgtcgatgcgggcggcctcatactggttctccgacacggactggagggaggcgtacagcagcagaaacacaaaggggacgttctgccacacgtcgatcagcaggatcgtgccgaaggccgtttttgtgtccatgaaccagttgaacaccggcaggcccagtcccttcaggaactggttgatgatgccgtagttggcggagagcatcatccgccagctgagggccaccgtgacggcgggcagcagatagggcaggagcagcagcgtccgcataatcttctgccctcgcttgagggagttgacaaatactgcgatcagaaggccgagggccatctccagtaccaccgccaggatagtgaacttgatggtgttccacaccgcctgctgaaaatatccgtttttaaagagggagacgtagttatcgaacagcacaaaagaggcgttctccgtgcccttcaggtagttgtagtcggtaaagctgtatacaaatgtgaaaatcaggggataggccgtcatgaccagcaggactatcagggtgggcgtgagcattccgatcccgaaccggtttgtggccgcctgggcgctattcagttttgcaatctcgtttctcttcatacattggcctcacaaactcgagaggtgtggcccagggcccggctccggggcttttggaacaacggccggggcgccagacggcgccccggccggccgtgtcatttctgtttcagagaggctgggctcaggccatcagctgctccagctgctcctgggcgtaggccagcgcctcgtccatggtcttggtgccctggatgatgttgtccatctcggtgcctaggatgttggtgaactccgtccactcctcgatcacagggcggtacacgccggtctccagagcgccgcagacggtctgcaggtggggataggtctccagcacggtggaatcggtcaggcagctgtaccggcagggcacgccgttgttctcaatggaggccagctgcacctcggggctcatgacgtactccagcagctccagggccaggtccttgtggggggcgttgtcggggatgccgatgcaccacacgccctgcagggccacggcgtccacaggcgcggagtcgtcggtcagcttggtggggatggtggtgtagttggcaggaccatcagcagtgggggtgtaccagccgggccagatctgggccagggcggtctcgccggaggtcacggaagccacgatgtcgtccttgtccagggtgctgcccagggcgtacaggtccaggtactcctgcatggcggccttgaactcgggagtgtcaacggtggggttgttgttctcatccacgacccagccgccgtggacaaccaggtggggcaggaagtcggacaggatgttgtcggcgctgccgccgcggatcaggaaaccgttcttgttggagtcggccgccttggtcttctgggcgatgtccatcagatccgcgaaggagtcgatatcctcgggggcgtagccggcgtccgccagcagctgcttgttgtacatcatgaccgtcacgttgccgtagtagggagccaggtagatgtcctcgcccaccttgcagatggtggtggtggcgggaatgatgtcgtcatcaaagctgtatcccatctcgctgaggttggccagtacgccgttctcagtgaactcggccatccaggagccgtccaccatgcacaggtcgtaggtgccaacttcgttgacggcatccagggcgatgccggtgtgcaggtcgtcgaaggacatgagcatcacttcgatgtccacgttgtgctccgcttcaaagggggccaggctggcctccagggactcgccgtaggcgccgccccgcaggatcagggtcatcttggtgggctcgccggaagtgctgccctcgctgccttcatcggccgtgtcctctccaccgccgccgcaggccgccagagacagcgtcatggccagcgccaggaccagggtaagcagttttttcatttcgtttcctcctactcttttccgcttgatgttgtgtcagggatcggaagtgcgatgtattttgttactctttgacagcaccgcttgacaatccggagatcaagtagttctgcgcaaagatcacaaacagggtgatggggatgacagacaccacgccgcctgcggccaccaggccaaagttggtcaggttgtcctccgtgttcagcaccgacagcgccaggggcacggtgtagttgctggggctgcgggtaaagatgaccgtgtaggtgtactcattccaggcgtacatgaaggacagcatggctaccgcggcgatacccggcgccaccaggggcaggacgatcttgcggaagagctgccactctgtggcgccgtccaccttggcgctctcctccacctcctccggcaggtcctggaaaaagctgatgaggaaccagataatcagcggcacgttgatgagcacgcaggccagcgtcaccgggatcttggtgttcaacaggccgatcttgctgaacatggtgtacagggggatggtgaaggccaccggaggcagcacgcggaccagcagcacccaataggtcattggccgcttcagcccgaagcggaatctccgccgggccaggatataggcggcgcagactcccacgatcagcgacagcaccagggagctcagcgtggtctgcaggctgttgatggcggcttggccgaagcccttgctgacaaacaggctgataaaatgctcaatggtgagggactgcgggatcagggagatatgcccctgcatctccgatgtagggcggatggccatggccaccagccaatagatgggaaacagggcgatcaccaacagcagggcgcagcccaggacttttcccactgtcccggctctttttctcgctttcatatcctctcctcctcgtttttgcgcatggcaaaattcccgccgcgcacccgcggcattctgtatttttccaaagtacgggtcaactggagccgcgcacccgcagctctgtgggcaccaccgtgacctgggggacgtccgtctcccctgccagcagcgcctggagccgcgccacgctcaactcccccatccggcggcagtcgatgtggacggaggtgagctccggctccagcatcccgcaggcggagctgtcgtccagtcccgtcaccgccaggtcttccggcacccgcaggcccaggcggagggcggccttcatggctccggcggccatcacgtcgtttccgccgaagatggccgtgggccggtcctgccgggacagcagctccaggcaggcctctgcggcactctccaccgtgggatcgcacagcttgatgtgccgggtgtctgccggcaggccgtgggcctgggtgacttccagaaaggcccggtaccgctctcccagtatatagggggagaagcgccctgccagcatggcgatgttccgatgaccccggccgatcaggtgctccagcgcctggcggaccccgccgtattcgtccgacaccacgcagggaatgtccagtccctggatgcggttgtttaccagtaccacggccagatcccggttctggagctctgcgatcatatccggtcgggcattgccgcccaggatcacaccctccacctgtttgtttttggaggtgttggaggccgtgtcccagtccgcagcggtggaaatgaccaactcaaagtcacttcggttcgtctcccgcatgatcccggtgcagatgccggcgtagaattcgtccaggatcgtggccccctccttacagatcaggaaggcgatcttgtccgttcgctggcgggccatggcccgggcgatggcatttggagagtagtggagcacttccgctgcttcaaacaccttccggcgggtgtcctcccggacccgctccggattggagaacgcgcgggacacggtggcgatggaaactccggacagtctggagacatcatagatggttggattcacggtcacgccccttttcacgtaagcgttttcatatttttcgtaggaaaataacagtttttttgttgtaaagcttccagtgttttcctggatcaagtcaactttaacacttttttgcggtggaagcaagggattctttgtatttaatgtacattttacacaggtgtagaaaagctctaacattccttgtatagatcggcagaaatgtaaccgcttccattaaaagcacttatgacagatgatactgctccgggaatgtgagaggtgcttctctccaggcttgtctttttcccgcgcctatattatactgttcacggaattctcaggaaaagagctgatgggatgtacagagccaggtccgccctccgccatgggcagatgtccgaggcattttccaccatggtttttctgaccctgtccggcgggctgcaggacgcttacacctactgcgtccggggacaggttttcgccaatgcccagacgggaaacatcgttcttatgagccagcgggcctttgccggggatctggccggcgtcctccggtatctgatcccgctgctggcctttgcgctgggcgtctttgctgcggagatggtccgccgccgctgtcaggagatttcccggctccactggcggcagatggtggtgctggctgagatcggcctgttgctgggcgtgggattcctcccatcgtcctgggatgcgccggccaacgcgctggtgtccttcacctgcgccatgcaggtccaggcgttccgcaaggtcaacggcagcgcatacgccagtaccatgtgcatcggcaatctccgcagcggggtggacgccttctgcgcctactgggacacccgggaccggaccgccctgcggaaggccggccgctacttcgccgtcatcctcatttttgccctgggggccggattcggcggcgttgcctcccagctctggggaacaggggccatctgggccagctgtctgctgctggccgtcagttttcttctgatgttccggcaggagatccaggcggaagcggactgctgaggatgcggggaacggcctccatccggatttcacaccaataatgatatgatgaggagaatgagaaccatgtctgaaacagccaaaatgctccatgtgaatctggcccccggagaggcgggccgctacgccatcgtccccggggatccggaccggtgcgagctgatcgccgcccacctggacaacccccgcatggtgacccggaagcgggagttcaccacctgggagggcacgctggatggagagcgggtcaccgttacctccaccggtatcgggggccctccaccgccatctgcgtggaggagctccataagtgcggggcggataccttcatccgggtgggcacctgcgcctccacctgcgccgacgtccagtgcggggacatcgtggtggtcagcggcagtgtccgcatggacggcaccagcctccactacctgcccatggagttccctgccgtccccagctaccagctgctgaaggctctggaggagagctctgtgtctctgggctttcacaccacggtgggcgtcagcatcaccaaggactccttttacacgcaggcggagccggagacgaagccggtgtccgatgatctgatccgccgctggcagagctatgtccggggcggtgccgtctgcacctccatggaggagtccatcctcttctctgtgggctccagcctggggatccgcaccgcctccatcctggtatcagccaccaatttcgacgggtccgtctccaagcgcaacagcgccgacgtctatcccaccgacagcatccagaagcccatcctctccgccatcgaagccctgcgccggatcatccggcaggacaagggctgatctccctccggatatcaaaaccgccccgtgccgcaggcacggggcggtccttttatatcacatctctccgccgtactcccggcggtattcctccagctcttccgcgtcccggtcatccagggcgtgaaggccgccccggccctccatgtggtgggtcagctcatgggacagggtggtgtacagctcgtcctcccatgtttcctggccccagtcctcccgctctgcaagggcggcaaaggagccgtagtacaggttgatatactggcccagcaggtcgtcgcagtactcccccaggatatacatctcgccctccgggaactccgggtccggcttggcctcctccagcaggttgatcccgccgttgaggccgtcgaacaacgccgccgggaaactgtctgccatgtcgtccagcaggtcgttcacccggtcgatggtcaggatcatggctgtttccctcctcacgccttgggcacctgcttcatgctgaggccgatgcgctttttcttctcgtccacctccagcaccaccacctggacgatgtctcccacagacaccacctccgaggggtgtttgataaacttctgggacacctgggagatgtggaccagcccgtcctggtggacgccgatgtccacgaacacgccgaagtcgatgacattccgcaccgtgcccgtcagcaccatgccgggcttcaggtccttcatctccagcacgtcggtgcggaggatgggcttgggcagctcgtcccggatgtcccggccgggcttcatcagttccgccgccacgtcccgcaatgtgggcacgcccacgccgcagtccgccgccgcccggtcctcgccgtaggtcctgatctgggcgttcagatctcccagcttcccatcccgcacgtccgtgagggtgtggccggtgagggagagcaatttctccgccgcggcgtagctctccgggtggacggcggtgttgtccagcacggagcggctctccggcacccgcaggaagccggcgcactgctcaaaggccttgggccccagcttgggcaccttcaagatctgcttccgggaagtgaaggggccgttttcctcccggtaggccaccacatttttcgccgtggtcgcgttcagccccgccacacgctgaagcagggagggggaggcggtattcacgtccacgcccacggcgttcacacagtcctccaccacaccgttcaaagcctcgtccagccgcttgggggcatgtcgtgctggtactgtcctacaccgatggccttggggtcgatcttcaccagctccgccagagggtcctggaggcgccgggcaatggacacggcggagcggaggttcacatcgtactgggggaactcctccgccgccagggggctggcggagtacacgctggccccggcctcgctgacgatcatgtagctgacatgggcgccggcctcattcacctgccggatcagcttcaccgccatctgctccgtctcccggctggctgtgccgttgccgatggcgatgtgctccacgccgtgctttcggatcagctttgccagggcggcgatagcctcgttctcctgccgctcgccgtaggtggggtataccacggcggtgtccagcactttgcccgtgccgtccaccaccgccaccttgcagcccatccggtaccccgggtccaggcccatggtgaccctgcccttcaccgggggctgcatcagcaggggcttcagattcagggcgaactggccgatggccccctcgtccgcccgctccgtcaggtcggagcgagcctcccgctccagggcggggaagatcaggcggtcgtatgcgtcctccgccgcggacttgataaattccattgcggcgctgccggggacgatcacatgccgccggacggcctggagggcccggtcccggtccagctccacgcggaccttcagaaagccctccttctcccccggttgacggccaggatctggtgaccctgaagccgggagagggcctgggagaagtcgtagtacagccggtagacagagtcctcctccaccgccgcctgggagcagagctttccctcccgctccaggagggtgcggagggtcttgcggagggcggcgtcgtcgctgatggtctcggcgatgatgtcggaggcgccggagagggcgtcctccaccgtctccacgcccttttcggcatccacataccgggcggcctccgccgtcgggtccgggcagtccggcccctgggcaaacagcagctccgccaaaggcgccaggcccttttcccgggcaatggtggcccgggtgcggcgcttctgcttgtaggggcggtacaggtcctccacctccgccagcgtccgggcggcgtcgatggcggcggagagttcctccgtcagcttgccctgttcctcgatagaccgcttcaccgcctcccggcgttccgccaggttccgcaggtactggaggcgctcctccagattccgcagggcggtgtcgtccatggcgccgtgaagctccttgcggtagcgggcgatgaagggaatggtgttgccctcgtccagaaggcggaccacgttttccacatggcgggggtctttgtccagctcagatgccagttgttgaatgagatcctgcatgggttatgattcttccttttctacgtgaaatagggcggcagtctgctgcccgggaaattcagctatgggataaccgggcagatacacccgatactgggggcgggtgccgccggatgccggatagcggtgaagggatcgctgttcccaaagaagggcttgcacaacggggcgtgtgcggccacgtccccaaaggaccgcttttggatgcgctccggtgcagtggttctcctcgccggcaggaagcggcatatcggtatctgcgccaatcatgtctgaggttcgggtgcgctgttctttttgcggggcgtacagctgctgccccatgccgggaatgctggcggcacaggtgtggctaccgaattacctcttcctctggtccgctgctgggtatcctgtcggggcagcccgtccgtctttataaccctggggccgtgcggccaaccagatcatctaaagtgacgccaaaatagtctgccagggcaatcagcccttgaaaatcaggatagcgcttcccctcttcataatagcgataggcccgcacagtaattcccaaatgggctgccagatcctcttttgtggcatttttttcttttcgcaattcctgcaaacgctctgaaaatctttccatatattctccttgacggaacttaaagttcctagtataatgggaacataaagttcttcgaggtgcatgattatgaacgacatcttgtctgccatctaccggaatcttctggagagccgattttcagcatctctctcctgcccggattaccggcgagctattatacgggtggaacagtgcatggatgagctgcgccaggcactacctgccgaagagcaggagctgccggagcagttctgggacgcctgctccgacctccagctccatgagatggaggtcatgtttcaggtaacatggaccgcggcccgggaaatctgattcctgttttacttatgatagagcttcttcgtctcgtaccgggcctcgcagctgacgttgatgcccaggcggcgcagaaggttttcgtccacctcgctgaggatcaccgtgaagtgggcgtcgcagccccggagcttgggcagctgctgctgggccagctccgccagggggttggtcagggcggagatggtgagcgccatcagcacttcatccgtgtggagccgggggttcttgtggcccaggtactgggtcttcagccggcacaccggctccagcacctgggcggagatcagctcgaactggtcaccgatgccgcccacggccttcagcgcgttcagcagcagggcggaggccgcccccagggtgtcggaggtcttgccggtgaccacccggccgtctggcagcaccatggcgccggcagggccgccggtggtctccgccttcagcagggcagcggacaccgccgggcagatgtccggtgtgacgctcgcctgttgcatcaccagctccagcttccgcaccggctcgtccccggctttgccccgcagccgctccacgcaggcggtgtagtagcgccgcaggatctccatgcggctggcggcgcagcacaccgcgtcgtcacagatgcagttgccaaccatgttcactcccatgtccgtggggactggtagggggacgtgccctggatcttctcaaagatggcgttcagcaccgggaagatctccacatcccggttgtagttgacggcagtcttgccataggcctccagatggaaggggtcaatcatgttcacgtcgttcagatccgccgtggccgcctcgtaggccagattcaccggatgcttgaggggcaggttccagatggggaaggtctcgaacttggcgtagcccgcagcgatgccccgcttgtagtcgtggtagagctgggagaggcaggtggccatcttgccgctgccggggcccggcgccgtcaccaccaccagcgggtgcgtggtctccacatactcattctttccaaggccctcgtcgctgacaatgtgctgcacgtcggaggggtagcccgcgatgggatagtggcggtagcaccggatgcccagggtggtcaaccgcttcaaaaaggcgtccgccgccccctggccgctgtaccggctcatcaccacgccgcccacatagaagcccatgccccggaagatgtcgatcagccgcagcacgtcgtcgtcataggtgatgcccaggtcccccggaccttgtttttctcgatgtctgcggcgttaatggcaatgaggatctccacgtcgtcctgcagctgctggagcatccggatcttgctgtccggctcgaatcccggcagcacccgggaggcgtggtagtcgtcgaacagcttgccgccgaactccagatacagcttgccgccgaactgggcgatgcgctttttgatctgctcggactgggtggtgaggtacttctgattgtcaaaaccgatggccggcatacgatcttccccttttctctctggttgttcaaaatccggtgatagtataccacaccctgtcccgttttggaagtggagaaccaaggcttttccgccgcgccctgcatcttgcaggcgtccagctcccatggtacaatcagcggagaatttgcagggaggggatccagatgcgcaacacctttgaccgcttcaatggccggcaccaggactatcaggccgccagaccttcttatgcccaggaattcctggactggctgggagagctgtacgcgccgccggagcgctatacagcggcggacatcggatccggcaccggcaagctctccgcccagctgctggcagcgggcttccgcgtctgcggcgtggagccgaatccggatatgcggggggcggcggaggcgcttctgggcggcgatccccggttctcctcctcaaatggaacggaccatgataccgggctgccggaccggtccgtggacatggtcgcagcggcccaggccttccactggttcgacggtcctgcctttgcgcgggagtgccgccggatcctgcgtcccggcgggcgggccgttctcgtctggaacgtccgtgggtctgcaccggtgaaccaggccttggcccaggtctttcgggagcactgcccgagctttcacggattcaccggcgggatgggggaggacgacccccgcatccgggattttttcggcggggcgtatgaaaagcggcggttccccaatcccctgacgctggaccgggaccgattcctccggcggtgcttttccagctcctatgccctgcgggagggagacgcggattacgaagcctttcgggcggcgctggaggcgctgttcgacactttcgcctccggcgggcaactgattcagcccaacgagactgtggcctatgtggggatccccgccgctccccagggatgaggcatttccagaattgaaaggtcgaccttatcagaaaaaataatgcttattattacaagttcaggctttacttatggaaaatcagccgatataataactaaggttgggcatctttggagaaaaggtcgacctgaccggagtgtctgtaaatcaaaaccgggaggtttttggatatgtcaaattgtgccatcgtgggaatcaactggggagacgagggcaagggccgcatggtagacctggtgaccgcggactacgacgtggtggtccgctatcagggcggcggcaacgccggccataccgtggtgaacgagttcggcaagtttgccctgcacctgctgccctccggcatcttccgcaagggtgtggtgaacatcctgggcaacggcgtggctctggattgcgagagcctgtggaccgagatgtccgacgtcatggaccagggcgtggccatcacgccggagaacctgaaaatcagcgaccgggcgtccctgctgctgccctggcaccgggacctggactccctggaggaggcccgcctggcggacaagaagtacggctccaccaagcagggcatcgccccgttctattcggacaagtaccagaagaagaccatcatggccggcgagctgctgtacccggaaaagctctgggaccatctggcgggcattctggagtggaagaacctgacgctggagcgggtctacggcgccaagccctacaccatggatgacctgaaggcatgggtgacggagtttggcgagaagatcaagcccttcatctgcgacaccggcgccttcctgcgccaggcccaggccgagggcaagcacatcctgtttgaggcccagctgggctccctgcgggatctggactacggcatttacccctacaccacctcctccaaccccattgcggcgtatgcccctgtgggctccggcctgcccaccgccaagctggacaagatcatcggtgtggtgaaggcatactcctcctgcgtgggagagggccccttcacctgcgagtggttcggtgaagaggcggagaagctgcgggaggccggcggtgagtacggcgccaagaccggccggccccgccgggtgggtcccatcgacatcgtggccacccgctatggcatccagtgccagggagccacggacatcgccctgaccaagctggatgtgctcagctacatggatgagatccccatctgcgcccgatatgagctgaacgggcaggagaccgacgcgttccccttccccgccgtgctgccggacgccaagcccgtcatgactgccatgcccggctggaagtgcgacatctccggcgtccggaagtgggagaacctgccggaggcggcccggaactatgtggaatacgtggagcgggagatcggctgccatatcacctatgtgtctgtgggaccggaaagagattccatcatcattcggtgaggaggaaatccgatgctgtttgccgtattcgggtggatcgcgttggcaggtgccctctgctggccgtttctcctttaccggatcatttcaaaagcatcgaaggatcgttccgcgggtgtcgagtgtttcctgttggcactgctcagcctggatttttgtctctggctgtttacagtttttaccgcactccctgcttcataaatgcttcgcctccggcgaaacagatcgtaccctctggaggcacccatgccggtgcctcctaaacttttgagcgaaagaaaggtggacctcttatgtccaaagaacgttacgaatccccctggcgtcccggtacgcctcggcgttcatgctgcacctgttctcccccgacatgcgctttgagacctggaggcggctgtgggtggccctggcccgggccgagcgcaatctgggcctgcccgtcaccgcggagcaggtggcggagctggaggcccacatcaccgacatcgactatgagacggcttcggcgcgggagaaggaggtccgccacgacgtgatggcccacgtctacacctacggcaaggcggccccctccgccgcggggatcatccacctgggggccaccagctgctatgtcaccgacaacgcggatctcatcatctaccgggagggcctgcggtatctccggggagagctgctggctgtggtggcgaacctcagtaaatttgcagagcaatacaaggccacccccaccctgggctatacccactatcagcccgcccagctggtgacggtgggcaagcgggccaccctctggatgcaggacctgctctccgacctggaggagctggacttcgtcctggaccacatgaagttcctgggctgccggggcaccaccggcacagaggccagctttatggacctgttcgatggagacggcgccaagattgacgagatgaaccggcagatcgccgcagaattcggttttgagcagtgttatgccgtctgtggccagacctatcccagaaaggcggacagccgcatcctgaactgcctctccgccattgcccagagctgctaccgcatggccaacgacatccgccttctccagcacgaccggcaggtggaggagccctttgagaagaaccagatcggctcctctgccatggcctacaagcgcaatcccatgcggtccgagcggatctgctctctcagccgctacctgatggcggacgccatgaacgcccccatgaccgcctccgtccagtggttggagcggaccctggacgactccgccaaccgccgcatctccatgccagagggcttcctctgcgccgacgccatcctgcgtctcagtcagaacgtcaccgacgggctccacgtcaacgagaagatcgtggaccggacctgccgggagtacctgcccttcattgctacggagaacctgatgatggagggcgtcaagcggggcggcgaccggcaggcgctccacgagatcatccgcacctgctccatggccgccaccgcccggatgaaggagggggagccctgcgacctgctctcccgcctggcggcggagcctgccttcggcatgaccgaggcggagatggaggccgtgctggacccgaagctgtacatcggccgctgtccggagcaggtggacgccttcctggcccaggtgaggcccctgctctccggcgccagccgggaagtcccggagatcagtctctgaccgtttcataccgtccgggcgccctgcccgccgtgcctgcggcgggaggggcgccggaacgcttttcaggcggaaccccttcggctgtcccggagcggaggagccgggaaggctgccggaaatggaatgccgattttgtgggttttgacgttgacagtgcgctgctggcggtgatacactgctaccatcgctttcgagatcgaggccaaatccaaccatcagaaggcattgatggagaaaaggatcgtggaaattccggttcagtgagcgggggcagtgggaagcccgtacaaagagtccgcgggaagaagactctgcagctgcattccgaacgcggatctccgctagtaagtgcgacgagttgtgatcgttatctcacacgggcttgttggagctttgaaagggatcccatcatgggagcaaattaggtggtaccgcggatcgcagctattcatcctaagattttaggagaaagctgcgttctttgttatacgctccatagcaaagagtgctctgcgccagtaccctgccctttgggcagtcggcggctgatgcgcaaattcatccgggaggcgcttctgcccatgtgcggggccatggttttttcaaaagatctgtaccaaggaagagctgctgcccctcttcggccggacgtattttgactttgagacgctgcggaggaagggcggccgtcgtccgccctttaccaaggtgagcctgctggaccgggagatcttcgggcaacaccattccggccggaactggatgcttcgggacttccggatgcccaaccggtcctgggggatgcgacgcggacggcctctgtgcccggggcccctccgatgacggcgagagcggcaaatgaggcggaaaatccgcatttcctgttgagttttccatatctgatgtgatacgatacattttataaatacaggaggatgaaacgcatgagtaccaccacgaaactctccgatctgttcggcagcatggtcttcaatgaggacaccatgaaggagcgcctgtcctctgcgtcctatgaggcgtggaagaagtgcgttacagacggaacgtctttggatatctccaccgccaatgagatcgcccaggccatgaagcagtgggccgtggaaaagggcgccacccactacacccactggttccagcccatgaccggcgtcacggcggagaagcacgacagcttcattgcccctgccggcggcggcaagatcctcatggaattctccggaaaagagctggtccggggtgagccggatgcctcctccttcccctccggcggtctgcgggccacctttgaggcccggggctacaccgcctgggatcccacctcgtttgccttcatcaaggagggtagcctctgcatccccaccatcttctgctcctactccggcgaggccctggacaagaagacgcctcttctgcggtccatggacgagatcagccgccaggcggtgcgaatcctgcgcctgttcggggacacgacgaccaaacgggtggtggttcaggtggggccggagcaggagtacttcctggtggacaaggcccagtacgcccagcgggaggacctgcggatgtgcggccggaccctgttcggcgcaaagcccccaagggacaggagctggacgaccactactatggcgccatccggccccgggtcgccgcctatatgaaggatctggatgaggagctgtggaagctgggcgtgctcagcaaaaccaagcacaacgaggtggccccctcccagcatgagatggccccgatctacaccaacgccaacgccgcctgcgaccagaaccagctggtgatggagatgatgaagaaggtggccgaccgccacggactggtgtgcctgctccatgagaagcccttcgcgggcgtcaacggctccggcaagcacgacaactggtccctctccaccgacacgggcaaaaatctgttcaagcccggctccaccccccggcagaacgcccagttcctgctgtttttggcggccttcatcaagggtgtggacgactatcaggagttcctgcgggccacggtggccttccccggcaacgaccaccggctgggcgcccaggaggcaccgcccgccgtgctctccatcttcctgggagacgagctctccgctgtggtggactccatcatcaacgacacggacttccagagcaccggcaagcggacgctggagatcggcgtggacgccctgcctgccatccgccaggacaacacggatcggaaccgcacctcccccatggcctttaccggcaacaagttcgagttccggatgctgggcgcatcccagtccatctccggccccaatatcgccctgaacaccatcatggccgaggagctgaaacagttcgcggacgagctggaggcatcccgggacttccaggcggacctgcccaagctgatccgccgggtattcaccgagcatcagcggatcatcttcaacggcaacggctatgacgaggcctggctggaggaggccaaaaagcgcggcctttccaacctgacctccaccgctgacgctctgcccatgtacaccgctcccaaaaacgtggatctgtttgtcaagcacggcatctacaccaaggaggaaatcgaggcccgggcggagatccacattgagaactacaccacggtcctgaccattgaggccaagactatggcggacatgatccgccaccagatcctgcctgcggtgtccgactacgccgaccagctgtgccagcgggcctatcacaaggacgccatgggtgtgccccaccagtatgagacttccacagccatgcagatcggcaccctgacggacgccctgcaggcggactgcgccaagctggaggcggatctggccgctatccccgtgggctctatcaaggccatgaactactgccatgaggtgctgatccccgacatggcagaggcccggaaggccgccgaccagttggagacgctgactgcctccaagtcctggcctttcccggtatacagcgacctgctgttctacgtataaagtgcgcaagagggccccggccatcggccggggccctcttggattcatctgttacaccagcacgtcgaagaacagcgccaaaatagtggtggcgaggccgcagaggccgatggcaaggccgctcatggccccctccgtctcccccagctccagggcgcgggcggtgcccatggcgtggctgcaggcgccgatggccagccctgccgccaccggatccttcacccggaagaggcgtgccagcgcgggggcgcacaggttgcccaggatgccggtgaagatcaccgccgccacggtgatggagacaatgccgccctgcccctccgcaatggcggtggcgatgggtgtggtgacggacttgggcaggagggagacggtcagtgtccggtccaggccgaacaggcggcacaggccccagatgctgaggaccgaagtcaccgccccggccgcgcatcccgccaggatgggcagcaggttctttttcagcaggtcgatctgggcgtagatggttactgccaggcagaccgtggccggccccagaaagaggttgatgaggctgccgccggcgttgtacgctgcatagggaatgtcaaacaccgccagcaccgcgataatcatcatcaccgccagcaccaggccgttgcagatcacaagcccggtccgcttctggattttgcagcctgcccagtaagccaggatcgtcagcgtcaccccgaaaaagggggactcccacagcgcgctcatctccgcttccccctctccagcaggcggcaggtgagccgcaccgctcccactgtagcggcaaaggtggcaatcagcgagaccgcgcagacgaccaccagggcaagcaggttctcccgtaacacatctgcatagttgatgatgctgacactggccgggatgaagaagaaggggagattccccagcaggtagtccgacttctcccggatgtgttctgtcttgatgacgcgtgccagcagcagcgccagaagcagcagcatcccgatgatgctggcaggcagggtgaagggcaacacccgctcaatacaggtgctgatccagcagatgccgaagatgatgccgatctgcgttagaagtttcaaagtgaaccgcctctcccggcggtcccccgccgcgttactctgcgccgtattcacacaagggcgcggattcttttcaacttttttattctacggagacggccggggaatgtcaaatccttccggctcctttttctgccgccgccgcaaaattcggcaaaacagtacaaggccccgccgggaaagagcgggaccttgtccaggtcatccaagcatccgcaggaggccgggggactcagaggggcatttgccgctccagctcccggcggaagtccgggtgggcgatggcaatcagcgcccgggcccgctccacggtgctcttgtatttcagatccgccacgccgaactccgtcaccacatactggacgcaggtgcgggggtggtcaccacgctgccgggggccagctgcggcacgattttggagtggaggacccccgccttgtcccggtagctggaccggagggccaggatactctttccgcccttggaccactgggagcctaccacccactccagctgtccgccggtgccggagtactgccgggggccgatactctcggcattcacctggccggtgaggtcgatctccatggcgttgttgatggagaccacatggtcgttccgggcgatgttccgggcatcgttcacccagtcgatctccttctggcagaaggcgggattctcatgggcgaaggcccacagctccggcccgcccaccatgttggcgtatacgctccgccccgggcaggtctgtttgcggctgttgttcaccacgccccggcgcatcagctccatgacgccggtgctcaggatctctgtgtggacgcccagatcccgctttcccgcatgggccagacactcgcccacggtattggccagccctcccagccccagctggatgcaggcgccgtctggcactagatccgcgatgtagcccgcgatgcggctgtccgtctcgtttcccgctgcgatgggcgtctctaccagaggacggctggattcgatgatcccgtccacctctgatacatggatgcgggtgtgggcctccccatcactgggaatattgggcattcgggggttcacctccgccagcaccagctcgcactgctccagcaccttccggctcagggccgtgccccacagggagcggctcatccacccgttctcatccgggagcgagcaggtcagcgccgccacccgggggcgccgggccaggagccacgcgggcgtctgactcaggttggagggggcgtaatggacgttgcccatgggctccaggccccgctccacgccgtaaaagttggagtcataagtcacctgtccggccagctccggcgtcagcagccgggtcccggcggggatgaagtgcccgtagatggcgatatggccgccggtctccagcaggcgctccgccagcgccccgtccagctcccagggccagttggacatggcggcgaaggccgccgtgtccccgtcccggatcagctccgccgcctcccgggcggtcatctgcagggcctgatactgggtctgccagttgcccgctcccgcgcagcgtccccggcggatgggtgtcagttctgtcatcgtcattctcctttgccgcgcccctctgcggggcggtgtctccggcggtttgtacagcccgccgtgggggccgcggccgccggttccctttcccgtctattgtaccgcacattccgcttccgcacaatcctcttttccgcggacgagttaatagaaattttgtttttttctgcttgcgcccggccgcttcgccgtgctatactggcgttgttcttgattttttccatggaggtgcatcttgcagaaacgcagtcacaaactgctggccgccaccctgctggagaatacccagggatttcaggccagacgattcgagctcgccttcctgttcggctcctttcagccggactgcaaccccctgacctatttgaagggctccctgcgggcctataagttccgggggcataactactccaactcccagcactacatctactcccgcatctcccggctccagcgccgccagcgctggaccatctggcagtattacaccctgggcaaactgacccactatctggcggatgcgttcacctatccccataacgagaattatcccgacagtatgctctgccaccaccagtatgagacggacctgcgggcctatctggaggagtatctggccacccgcgcccttcgtcgggagaagttccgtcaggacgtggcggacgcccttcaggagctgcaccggcagtacatggccggcgtggccgatatgcgcaaggatgtgcagttcatcctgaaggccacctccctgctgatggccggctgcctgcctgccagcgccgcagcggctgtctgaaccctgttttgggaaaagcgcacagcagcggtttccctttcggcgcattctttggaatcattgtcaatttccatttgctttttctggtgttatcctgaaactatcaaaggactcggaaaggaacccagtcatgaccaacatcacccgttctgccgaataccgttactttagctttacctatttttatggtaaggcttatttcggtttggctgaaaatgtgtgtgatcgtgtctgacgccaggaaaaggctatcagtgcatgacgacccgcagccgaaccggctgcgggtcttttttgtaccagccccatcatttttaggaggaatacagtatgatcgtcgttctgaaacaaaaccccaaccggcaccagctggagagcctgatcgcctggctccaggaaaaggggatcatcatccacaccagcatcggcgaggcccacaccatcttaggactggtgggtgataccagccagctggacatcgacctgattgccgccctggacatcgtggaggatgtgaaacgggtccaggagccctacaagaatgccaaccggaagttccacccggaggacacggtggtgcaggtgggcaacacccagatcggcggcggcaatctgaccctgatggcgggtccctgctctgtggagagcgaggagcaggtggtggccattgccaaagcggtgaaggccagcggcgccaccatgctgcgggggggcgccttcaagccccggacctccccctactccttccagggcctgggggccacgggtttggagtacctgaaggtggcccggcaggagaccggcctccccatcgtgacggagctgatggacctgagccagctgcccctcttcaaggatgtggacgtgatccagatcggcgcccggaacatgcagaacttcgacctactcaaggccgtaggccatcaggacaaacccgtcatgatcaaacggggcatgtccgccacctacgaggagtggctgatgagcgccgagtacgtcatggccggcggcaatgagaatgtgatcctctgcgagcgaggtatccgcacctttgagagctacacccgcaacaccctggatctggcctgcatccccgtgctgcggaagctgacccacctgcccatcatcatcgatcccagccatgccaccggcaagagctggctggtagatcccctggccatgggcgccgtggctaccggtgccgacggattgctgatcgaggtccacaacgacccggcccatgccctgtgcgatggcccccagtccctgaagccggaggtgttcgacggcctggcgaagaagctgctgaagctccatgactttatgaagacggtggaggagtaagacatgaatgttgccatcgtcggcctgggcctcatcggcgggtccatggccaagagcatcaagaaccgcaccagccacaccgtctggggcatagacctgaacgcggagaccatgaccatggcccggatgtgcggcgccatcgacgcccccctgacggaggagaacctgccccaggcggatctgatcctggtggcgatccggcccggcgccgccatcgagtgggtccggcagcacgcgccgcagatcgccaagtccgccattctggtggacctgtgcggcgtgaagcggaccgtggtggcggccatcgcccccatcgcagaggaacgcggcttctcctatatcggcggccaccccatggccggtaaggagcggggcggcttcaccgcctccgcagaggacctgtacgtgggagcatctatgatcctgacgccggacaagcggacggacatgcggctgctggagacgctgaaggccttctttctggacctgggctttgcgggcctcaccttctcaacgccggaggagcacgaccgcatcatcgcctttacttcccagctggcccatatcgtctccagcgcctatgtgaagtcgccggaggcccagaagcgccgaggcttttccgccggcagctttcaggatatgacccgggtggcccgtctggatgaggacatgtggacagagctgtttctggacgatgaggacttcctcaccgccgagctggaagagctgatcggccacctgacggactaccgcaacgccttgcgggccaaggatactcagcggctgcacgatttgctgaaggagggccgggagctgaaggccaccgccggcggcaactgacctatttccggcgccgctgcgcgacatgattctataaaaggagtttttcgatgtttgactccatccgaaccattcccgtccgggtccggccgccctatgatgtgcgcattggcagcggcctgcttggccggtgcggggactatctggccgcgctgctgggacagcggaggatcgccgttctggccgacgacaccgtggcctccctgtacctggacaccgtcaccgccgctctggaggacgcgggctttgccgtctgctcccatatcttcccctccggggaggggcgcaagaatctctccaccctgacagagctactggagttcctggcgtcggagcatctgacccgcacggactgcgtggccgccctgggcggcggcgtcactggggacatggcgggctttgctgccgccgtgtacctccggggcatccggtatgtccagctgcccaccaccctgctggcggcggtggactcctccgtggggggtaagaccgccgtggacctgaccgccgggaagaacctggccggggccttctgccagcctgccgccgtgatctgcgacacggactgcctgaagaccctgccccccgacgtgtttgccgacggggccgccgaggccgtcaagaccggcgtgctctctgacgaagccctgttcgccctgtttgaggacggcaccctcaccgccgaccccggcgaggtcatcgcccggtgcgtcgcctacaaggccggcgtggtggagcgggacgagaaggagcagggggagcggaagcttttgaacctgggccatactgtgggccacgccatcgagaagtgcagcggctatgttatcccccatggccacgccgtggcggcggggctggccgtcatcgcccgggctgcggaggccctgggctggacggaggagtccctggcggcgcgaatcaccgcctgcctttctaaaaatggcctgcccaccgggacagactactctgctgaagccctggcggaggcagccctttccgacaagaagcgcgccggtggggatatcaccctggtggtcccccggaagatcggccattgcgagctgcggaaggtcccggtagcggacctgctgcccatcatccgggcaggactggaggcgtaaatggaccttcaaatcaccccgaaaaaactctccggcgccgtgacgccgccctccagcaagtctcaggcccaccgattgctgatcgccgctgctctcagcggcgggatcagcgtcatccacggcctggcggactcccaggacatccgggccacccgccggtgcctgtctgccatgtgtgccgggatggaggatctgccggatggcaccctccgggtccacggactgggaaacggcatcgtcatcgcacctccctatgccctgctggactgcggggaatcgggctctaccctgcgcttcctgatccccgtgggcctgctgatacagggagaggcgtccttcaccggccgaggccggctgatggagcgcccgctgaagccctacgaggacctgttccgggagaagggcatcgcctggaagctggcggacaacgtcctcaccgtaaacggcggtcggggatacggtaccctggccctggacccggggacataccgcctgcccggcaacgtatccagccagttcttcacagggctgctgttcgtcatgcccctgctggagggagactctaccctggtgtccaccacacccctggagagccgggactacctggagatgacccggcaggctcaggccgctgccggtgtcaccagccggtggctggacgaaaacacgctcttcgtccctggcggccagacctaccagtcctttgaggccacggcggaggcggactggtcccaggcggggttctggtacgccgccgatttcctggacagccgtgtggacatccggggcctgaatcccgactctgcgcagggggacaaggcagtcagcgaactttactggcggctggcccggccgggggacacggagatcgatgtctccggatgccccgacctgctgccgcctctggcggtgatggcggcggcccgctccggtaccacccggtttgtgaacgctgcccggctgcggatgaaggagagcgaccggctttccaccaccgccgccctgctgaccgccctgggcggacgggcggaggaggggccggactttctgacagtccacggcgggacgctcaccggcggcatggtggactgcgccaacgaccaccggatcgccatggcggccgccatcgccgccaccgcctgtaccggccccgtcacggtgctgggggcccaatgcgtgcagaagtcctacccggatttctgggaggtgtacaagaacctgggaggtgatatccatgtcctctgaattcggcagtctcctgaaaatctctgtcttcggccaatcccatggaagggccatcggcgtggtggtggatggcctgcccgccggggaggccatcgacctggaggagctgaacgccttcctggcccggcggaagccggggaagagccacctttccaccgcccggagggaggccgacgcgccggtgttcctctccggcctggaaaacggcgtcacctgtggagcccctctgtgcgcggtcatcgaaaatggagaccagcactcatcggactatgatgccctgcaggacaagccccggcccggccacgcagactacactgcatttgtcaagtggggcgggcaggcggacatgcggggcggcggccacttctccggccggctgacggcgcccctgtgtatcgccggcggcatcgccaagcagattctctcccgccggggcgtatacgtaggggcccacctccagtccgtggggacggtggcggatgcattattccccctgcggcccacgaaggagctgtttgacgccgtggctgccaagccattcccggtgctggacgaccaggcgggggagcggatgcaggcgctgattctggaggcctggaaaaatctggattctgtgggaggcgtcgttgagtgtgccgccacgggccttcccgccggactgggggagcccatgttcggcggcgtggaaaaccggctggccgccgccctcttcggcattcccgccgtgaagggcgtggagtttggggacggcttcgccgccgcccggtcccgggggtccgaaaacaacgacccctttgtgatggaggacggccgggtgcagacgcagaccaaccacgcgggcggcattctggggggcatcaccagcggaatgcccatcgtcctgcggacggccatgaagcccacaccgtccatcgcccagccccagcggacggtcagcctgtccgccggagagaatgcggagcttgtgattcacgggcggcacgacccctgcattgcccaccgggcggtcccggtggtggaggcggttactgccgccgtgctgttagatttattattggagggacatcatggaactttctgagattcgagagaagatcgacgcagtggacgagcagctgctggacctgttcctgcagcgcatggacctgtccgacgaggtggctgcctacaagaatgcgcaccatctgcccattttgaacaaagaacgggagcgggccatcctggccaaggtgacggagaaatccggggagcgggagcggtatgcctaccacctgttctccaccctgttcgagctggcccggtcccggcaggcagagctgatctccgcccccaccaaggtggccgcccaagtccgcgcctctctggaggccggtacctcggtctttccccagacgggcctggtggcctgtcagggcgtggagggggccaactcccaggtggcctgtgaccggctgctgccccggggcaacatcgtgtatgtgaagaccttccaggctgtggtgtccgctgtggagtccggcctgtgcaggttcggtgtgctgcccattgagaacagctccaacggctccgtccgggcggtgtacgagctgctgcaggaccacaacctctccatcgtccggtccacccggctgtgcatccggcacgagttgctgacgctgcccggcgtgaagatggaggacatcacggagatctactcccacgagcaggccatcggccagtgcagcaagttcctgaacagcctcaacggcgtccgtgtcatcccctgcgacaacaccgccatggccgccaagatggtggcggagaagggcgaccgccacgccgccgccatttcctcccacccctgcgcggcgttgtacggcctgacctgcctcaacgacagcatccaggacagcgacaacaactacacccggttcatctgcatcaccaaggatccggtgatctatgccggcgccaaccggatcagcctgattatcgcctttgacaaccggcccggcgccctgtatgaaatcctctccaagctggcggcactggacatcaacatgacgaagctggagtcctgccccgtggcgggaagtgactttgagtttgttttcttcctggagctggacgcctccgtccaggatcccagcgtcctggccatgctggaggagatggagcgcagctgtgccgagttccagttcttgggcaactacgcggaagtctgagccatggatgagcggatttacggcctgctgggccggaagctgggccacagctggtccgtccccatccatgccgccctgggcaacggcgcctaccgccttctcgagctggagccggatggactggctccctttcttcaccggaaggacatcggcggcctgaacgtcaccatcccctacaagcgggacgtgatgcccctgtgcgatgagatcgacccggcggcggaggccatcggcagcgtcaacaccatcgtccggtgcgcagacggcaagctggtgggctataatacggacatcgacgggttcctctatatggcctgccgggcgggtatctccctgtcagggaaaaaagtcgtgattttgggcagcggcggggcgtctctgacggcccagaccgccgcccggcaggggggcgcggcggaggttgtggtggtatcccgtttcggtccggacaactatgacaacctctctcgccacgctgacgcggagatcctggtgaacgccactccggtgggcatgtaccccggcaacggccagtctcccgtggacctgtccgtatttccggtctgtcagggggtgctggacgtcatctacaatccccggcgcacggccctgctgctgcaggcggaggcgcggagcatcccctgctctgacggactgcccatgctggtggcccaggcggtggcggcagaggagcggttcttcaacaggtccattcccgccggtgagaatgagcggattttggttcagctccggcgggagatgaccaacctcatcctgatcggcatgcccggcagtggcaagaccacggtgggggaggcgctctcccgcctcaccggccgggaggccgtggatctggaccagatgatcgaaaccaccgccggctgttccatcccggagatcttccagcgtgaaggcgagtccggcttccgggcccgggagcgggccgccgcggaggaggctgggaagcgcacaggcgtcatcctcctcaccggcggcggtatcatcaagacggcggaaaactacgcggccctccatcagaacggccgcatctatcagctggtgcgggatctcagcctgctgcccaccgagggccggcccctgtcccagggggcggatctggccgccatgtggcgggagcgggcgcccctgtacgcccgattccgggacgtggagattgacaacagcggcacggtggaggacaccgccgccgctatctggagggatttttgtgcacattctggtagttaacggccccaatatgaacatgctgggaatccgccagccggagatctacggccatgagacctatgaggacctgaaggcgctgatccgggcggaggcggaccggctgggcgcgtccgtctccttcttccagtccaaccacgagggggccctggtggacgccatccagcaggcatacttcgaccatgtggacggcatcatcatcaacccggcagcctacacccacaccagtgtggccctgctggatgccgtgaaggcggtggggatccccacggtggaggtccacgtctccgacccggacagccgggaggagttccgccgtgtctcctacatccgggccgcctgcgcggccaccatccggggccatgggctccagggatatgtggaggccctgcggtttctctgcggcgcggacgcttgacaaacggcggtctctgacggataatatgcccataccccattgggtatccgggaggtgtcggcatgagacaatgtatggatgcggacaacctgcaccggcggctgaagaagatcgtcggccaggtgcaggccattgaccgcatggtagacgaggacgtgccctgtgaggatgtgctgtcccagatcaacgccgccaagtccgccctccacaagtgcgggcaggtggtgctggaggggcacatccagcactgtgtccgggacggcatccagcacggggatgcggacaagaccatcgagagcttcaccaaggcggtggagcggttctccaacatgggttgaaggcaaggggatcggctgaaaagccgatcccctttgtatatgttacaggattttctccagagcgtaattggtcaatacctgtccgcggcagggcacctgctgttcccgctctatcgcatagccccggccgaggaagaagggcagggcggtcttggaggcgtggacagtgacggcgtccaccccaattcccggcagtgggcctccagcgcgtcacacagggctgcggcgatgccctgtccctggcagtcccaccggacgaacaggtggtccagataaccggtatcctccacattgccgtagcccacaatccgcccgcccgcctctgctaccagggtgtacagccgctgaaaccagctgtcccgtgtcagcagatccgcctctccggcggcccaggcttccacctggggcagggtgtagtcccggcagttcacctgccgaaccgtctcaccgaacaggcgggccagaatgggcaggtcttctgtccggtagcgccgtagtcgcatttctgttctctccttcctgttttgtggtcattttacaggaagaatctgtgtgccgcaaggtattttgcctgaaaacggcggcactttttcttgacaggcatacccctatgggtataatatacatatacccccataggtataaagagaggatgtgagccatttgatccatactctggagcgatttctggagtggggcggcgtgaagaaggccgtgacctgcctggtcttctccggcatcgccctgcttgtcagcatcttcgacctgctgccgcagctgccctttgacgccgcctgggcagctgtcgtcctctgcggtatccccatcatcttggaggcagtcatcggcctggtgacagcctttgacatcaaggcggacgtgctggtgtccatcgccttgattgcctccctcatcattggggaggacttcgccgccggcgaggtggccttcatcatgcagctgggcgccctgctggaggatctcacggtggcccgggcgcgggccggcatcgagaagctggtgcatctgacgccccagaccgcccgccgcctcaccggcggccgggaggaggccattcccgccgagcaggtggctgtgggcgacgtgctccgggtgctgccgggcgagaccgtgccagtggacggagagattctcaccggacagacctccatcaaccaggcggtgatgaccggcgagcccctgcctgtggacaaggggcccggagacgaggtttccagcggcacggtgaaccagttcggcgccttcgagatgcgggcgacgaaggtgggggaggacagttctatccagcggatgatccggctggtccagtccgccgatgccggcaaggccaggatcgtggggctggcagaccgctgggccacctggatcgtagtggcggccctgaccgccgccgccttgacgggcctcatcacccgggatcccatccgagcggtgaccattctggtggtattctgcccctgtgccctggtgctggccactcccactgccatcatggccgccatcggcaacgccaccaggcacagctttctggtgcgggagggagacgctctggaacggctggcctccgtctcccaggtgacctttgacaaaacaggcactctgaccctcggcaccccccaggtgaagctggtggagagcctgctgccggacgtatcccgggacgcgctctacgcctggactgcgggggcggagctccggtccgagcacccgttgggccgtgccgttgttcagggctggcgagccgagaccgtcgcggcgccgccggagacagcggacttccagatgctccccggccggggtgtttctgccactgtggcgggtcatcacctcgtcgccggtaaccgggagctgctgacagaggaacatgtcccctgggaatccttgtcccaggctgccgtccctgccctggagcagggctgcaccgtcatctatgtggcggtagacggccgcccggcgggctttctggccctggcagacaccctgcggccggacgccgccgggaccatccgggatgtccgggccaccggcgtgaccccggtgctgctcaccggcgaccacgagagggccgcccggcatattgccggagagctgggcatcggcaccttccaggcggagtgcctgccggaggataagctaacctggatcgaccgcagccagcagagcggccatctggtctgcatggtgggggacggcatcaacgacgctccagccctgaagcgggcccatgtgggcattgccatgggcggcgtgggcagcgacatcgctgtggacgccgcggacatcgccctggtaaacgacgacatccgggagctgccccatctgctggcactctccaagcggatgatgcgcaccatcaagagcaatctggccttctccatgaccttgaacttcatcgccatcgccctggctatcaccggtatcctgaacccggtggtgggcgccctggtccacaacgccgggtccgtgctggtgattgtcaactcctctctgctgctgaagtggcggaagcgcccgtgacagcggcaggccatgggacagaagattctgcgccctcctacagcaaaaagcccccggcctctgccgggggctttttaagtcctggcttctcaccccttcagggtgttcagcaggtgccggatgtgaatgctcatggcgtggcgggcgccagcctcgtcccgctgcatcagaaagtccagaatcatgtagttgtccgcgatggcgatgctctgcatgtgcgcccgatttacggagacctgcaggatctcgttcaccgcgccgttgatgatcgggtacagccgccgcatatattcgttgtgggaggccttgatgatggccatgtggaactcctggtccgccaggggccagtctccgcccgcctttgcgatgcgctccatccgctccgctttctggcggatctgcgccagttcttcgtctgtggcacgctgacaggccagcgccacggtggcgggctcaaagatcagccgcatttcaaacaggtccctggcccggacccgggaccgcaggttggacagcgccgtcagatccaccgcgctggcgggcagatcctccgtgacaaacgtgcccttgccccggcggatctccaacacgccctgggccaccagaaaggagatggcctcccggagcgtggtgcggctgacgtgcagcgcctcactgagttcgttttcattcgggagcttgctccccggcgtgaactgccgttcgtccatgattagctcgcacagccggtcggccgtccgctccgacaatttgactttccgtccctcacccatgcgcatccctccatcatccgtggtgaggtcaggcatttctccactggattttccggccagtacggaaatgtccttgacatcatatctcttttagagtacaatgacatcatacaacaaatgaaaaaataatacaactattttgtgaaaaaatgaggtgaaccgcttgtgacggccaaggacatgttttcccaccgcgtctcgatcctcaccggccactacggcaccggaaagacggaggtctccgtcaatctggccctggcgctggccgctgagggggaacaggtaatgctggcggatctggatatcgtcaacccctatttccgctctcgggagcggcggcccctcctggaaaaagccggtgtgcgggtgatttcctcctcccaggcctgttcggacgcggatgtccccgccctgccggcggagctgctgaccattctggagaaccgggagatccggggcatcctggatatcggcggcgatccggtgggcgcccgggtgctggcccggtttcagcccaagatcgtacaggaggattaccagctgatcttcgtcctcaacgccaaccggccggaggtgcgggatgcggagagcgccgccgcctacctccgctccattgaggccgtcaccggcctcacctgctcgggcctggtgaacaacacccatctgtgcggcgagaccacgccggccgaaatccgcaagggcgccgccctggcacaagaggtttcccggcagaccggaatcccgatcctctgccacacggcggagcggcggttcttagaatccttgtcagacctgggggaacccgtgttccccattgccatcaatatgaaaaagccgtgggagcgctgactccgcggcaggaaaaaaggaggcatcctgcaaccatgacagcaaaggtaaccttcaactctgaccggtgcaagggctgtgagctgtgcaccactgtgtgcccgaagcacatcgtcgccatcgatcaggccgtcatcaaccggaaggggtatcaccccgcccatgtgacggacatcagccagtgcattgcatgcgccagctgcgcgaagatctgcccggactccatcatcactgtggaaaaattctgagaaggaggtcatcgaccgtggaaaaagaactttggaaaggaaatgaagccatcgccgaggccgccatccgcgccggctgcgactgcttcttcggctatcccatcacgcctcagagcgaggtcccggagtatatgtccgcccatctgcccaaggcgggcggcgtgttcctgcagtctgagtctgaggttgcggccatcaacatggtgtacggcgccgccggcgccggcatgcgggccatgacctcttcctcctcccccggcatcagcctgaaacaggagggcattacatacatcgccggcgccgagctgccctgcgtcatcgtcaactgcatgcgcggcggtccgggcctgggcaccattcagcccggccagggcgattactatcaggccacccgcggcggcggcaacggcgattaccggacgctggtcctctccccctccaatgtgcaggaggcggtggacttcgtccaggaggcatttgacattgccgaccagtaccgcaaccccgtcatggtggttatggacggcctgattggccagatgatggagcccatcgagtggcgtcctgtccccaagcgggacctgcccccaaggactgggccaccaccggccgtaaggaccgggaccacaacaacatcatcaactccctgtacatggatccggaggagtgcgaccgtcacaacgaccatctggcggagaaatacgccctgatggagaagaacgaggtccgctggtccgagacggagtgcgaggacgccgagatcgtcatcaccgcctacggcacccctgcccggatcgccctcaccgcccttgagacgctgcgcgccgaggggctgaaggtgggcctgttccgtcccattaccctgtggcccttcccggaggaggccctgcgcaagctctccaaggccgaccacgtgaaggcatttttggatgtggagatgagctccaccggccagatgatcgacgatgtccgtctgtccgtggagggcagaaagcccatccattacctgggccacgccggcggcgtgatgcccaccgtggaagagatggtagaagcggccaagaaggccttgaaggagggcaagtgacatggcgatcgtatatgagaaatcccggggcctgacggacgtggagttccactactgccccggctgccaccacggcatcatccacaagctggtggcagagtcgctggtggagctgggtctgctggatgacgccatcggcgtgtgccccgtgggctgctccgtcttcgcgtacaagtatttcaactgcgacatgcaggaggccgcccacggccgggcgcctgccgtagctaccggcatcaagcgcacccatccccatcaggcggtgttcacctaccagggcgacggtgacttggcctccatcggcgcggcggagatcgtccacgccgccatgcggggcgagaagttcacgaccatctttgtcaacaatgccatctacggcatgaccggcggtcagatggcccccaccactctgatcggccagaaggccactacctgccaggagggccgcacccgggagcaggccggtatgcccatccgcatggcggagatgctctccaccctggacggctgcgcctatgccgagcgggtctgcgtcacggatatcgccaacatcaacaaggccaagaaggccatcaagaaggcattccagaagcagatgaacggcgagggcttcacctttatcgaggtgctgtccacctgccccaccaactggggcatgacgccgctgaaggccaatcagtggctgaaggacaacatggtcccctactatcctctgggtgtcatcaaggagacggccccggaaggcgcggaggtgaaatgagatgaaaaaagagatcgtcatttccggcttcggcggccagggcggcctggccatcggcaagaatctggcagaggccggcatggctgagggcctgaacgttacctgggctccttcctacggccccgagatgcgtggcggcaccgccaactgctctgtggtgctctccgacaagcccgtgggatctcccgtgttcgcccatcccaccgagctcatcgccctgaatgagccctccctggtcaagttcgaggagggcgttgtccccggcggcatggtattcgtcaacagcgacgtggtgacggataaagtctcccgcacggacctgacggcctactacatcccctgctcccagatcgccgacgaggtgggcaaccccaaggtcagcaacatggtgatgctgggcgcctatgtggccggcactaaggtgctgaaggcggagaccatcgagaagatgatccaggagatgttcaccggcgccaaggccaagttcgtccccctgaacatcgaggcgttccgccgcggcatggcctgcgtgcagtgatttgtttcagagggccggcgagtttgctcaccggccctctctctttggcgggccctgcgctttctgtgcattttaacagttgactttggctgtgtatcagcgtataaaagatatcatagaagaatatggctttatattgcgtggaacgggacacgccgcgaagatctctcccctcagagagctgccggacggtgcgaggcagcgggggcagctttgctggcctcccccgggagcagtgggcggaacagagctttcccagtacgccgcaccggacgccctccgttatcggggcagacgagcggccgctggaccagcggcaacgagagtggtaccacggaagtttgactttcgcctctcctgtgcagggcaggagtgcgcgaaagtctttttgctatcccccaaaacttcaaactatttttaaggagcgatcaatatgctggatattcaaatcaccaagaccaccagccccaaggccaagcccgcggacgagagcaagctgggcttcggcaagattttcaccgaccacatgttcgtcatggactatgcgccggacaagggctggcatgacgcccgcatcgtcccctatcagcccttccccctggatcccgcctgcgtgattttccactacgcgcaggagatctttgagggcctgaaggcctaccggaccgcggacaacaccatccagctgttccgccccgactgtaacggccagcggatgcaggactccgctgaccggatgtgcattcccaagatccctgtggaggacttcgtccaggccgtgaagaccctggtggaagtggacaaggactgggtgccccattctgacggcgcctccctgtatatccgtccctttgtattcgccaccgatgtgggcatgggcgtccacgccagccggaactacacgttctgcgtcatctgcgctccctccggcgcctactatgccgagggcatcgatcccgtccgcatctacgtggaggacgagtacatccgcgccgcgcccggcctgaccggcttcaccaagtgcggcggcaactacgccgcctccatcaaggccggcgagatggccgagcagcagggcttcgcccaggtgctgtggctggacggcgtggagaagaagtatgtggaagaggtcggctccatgaacattatgttcaagatcgacggcaagatctacaccgccccctgcaccggtacagtgctgcccggcgtcacccgccgctccatcatcgaactgctgaaggactggggctatgaggtctgcgaggagcacgtggccatcgccgacatcatgaaggccggccacgacggcaagctggaggaggtcttcggcaccggcaccgccgccgtcgtctcccccgtcaaggaactggactggaagggcgacaaggtcttcatcagcggcggcaagatcggcgagctgacgcagaagctgtacgacaccctcaccggcatccagtggggcaagctgcccgacaccaagggctggatcgtccccgtgtgcaagggctgagttcccatcgtcaaaaagagcggagccgaaaggctccgctcttttcctgcgtcccgctcagggctgctccgcttcataacgctttaaaatggcggccagagcctcagccgggatgtctcccacggggcggatcggctccggattttgatcgtagggggcgatgggcttttcaaaccaggccacatcccgccaggcgccgcacttgtacccagtgctgcggtaggtgcccagccgccggaagcccagggcttggtggagcccctcactcttttcattgggcacggtgacgcagccgtagaccgtgcggatgccctgcagccgcagaatgtctatcagggcgccgtacagccgccttcccagcccccgggaggtgcatgagcggtccagatagacggacagctccgcattccactgataggcggcccgctccgcctggcggtgggcgtaggcatagcccacgatccgccccttctccaggcatacgagatagggatactcccggccgacggcggcgatgcgtccggcaaattccgcctctgagggcagcgcacactcaaaggtgatgggagtgtccaggtattctccgtagatcttcagcagggcggcgctgtctgctggcgcggcaaagcggaacgccggcgctcccggggcttctctttcagccatctccgccgccccttacgtcctggcatgaatctgggcgccgcacttggggcaggtgatgacgattttccccttgcccaccggcacccggcagatggttttacagttcttgcaggtgaagtatttgtgggccttgtccgcatggcgggccttggcattctggcggctgctcttcatccgccacatccagttcacccaccgctggttttcgctccggcgcttggtgagattccgggagaagatgcggaacagggcgaaggcccaagcggcgatggacaccaggtacagcgcattccccagccacagatgatggggggccacaaacatggagacgaggtccagaaccagacttcccaccacaatggccaggctcaactggtccacgccgttgcgtccgtacatgagccgggccagtgcgttcccgattttttgaaagactcccatagataaggactccttttccggcggctcctgccgcagggtgtgattctgtcattattttacacgcaaacccaccgccgcacaaccgtttgcgggcggaatttacaaattggtcatttatttgttttgttcaaagtgctatactgatttctgttgagaaaaaacaccaaaggaagtgcaatatcatggcaaaacggcaattcaaggcggagtccaagcggctgctggacctgatggtcaactccatctacacccacaaggagatctttctccgggagatcatctccaatgccagcgacgcctgtgacaagctgtgctaccaggccctgacggatgacgccgtgggcatgagccgcaaggacttcaagatcgagatcaaggtggacaaggaacaccggactctgaccgtctccgacaacggcatcggcatggacaaggaggacctggagaacaacctgggcgtcatcgcctcctccggctcctacaagttcaagcaggaggtgggggacgacgccaaggacaccgacgtgatcggccagttcggcgtgggcttctactccgcctttatggtggcggaccacatcaccgtggtgacgaggaagtacggcgccgacgccgcctggatgtggcagtcctccggcgccgacggctacaccatcaccgaatgcgagcgggatgccgtgggcacggacatcatcatgcacatcaaggcggacaccgatgatgagaagtacagtgagttcctggagtcctggcggctccaagagctggtgcggaagtattccgactacatccgcttccccatccgaatggaggtctccaagacccgccggaaggagggtagccccgacgacaagccggagtacgagacgtatcaggaagaggagacgctgaactccatggtgcccatctggcagcggcgcaagtccagcgtgaagccggaggagtacaacaagttctatcgggacaagttccacgactacgccgacccccaaaaggtcatcgccgtgtccgccgagggcgccgtcacctacaaggcgctgctgttcatccccggtgccacgcccttcgactactacaccaaggagtacgagaagggactgcagctgtactccaacggcgtcctcatcatggacaagtgcgccgacctgctgccggagcacttccgcttcgtccggggggtggtggactctcccgacctgtccctgaacatctcccgggagctgctccagcacgaccggcagctgaaggtcatcgcggccaacctggagaagaagatcaagagcgagcttggtaagctgctgaaggacgaccgggagggctacgagaaattttggaagaactttggccggcagatcaaatacggcgtcgtcagcgaatacggcgcccacaaggacctgctgcaggatctgctgctgttctactcctccacggaaaagaagcccgtcaccctggcggagtatgtctcccggatgaaggaggagcagaagttcatctactacgcggccggcgagagcttggagaagatcgacaaactgccccagaccgagggcctgcgggagtccggcacggagatcctctacttcacggaggaggtggacgagttctgcgcccagatccttcacaccttccaggacaaggagttccgctctgtcctggaccaggagatcgaggagggtgccgagaagaaggccgaggaggccgcagacgcccacaaggccgtgttcgacttcgtcaaggagaccctgggagatcaggtgaaggaggtcaaggccagcgcccggctgaagtcccatcccgtgtgcctgacggcaggggagggcctgagctttgagatggagaagtatttccaggcggtccagccggacagcgccatccgcgccgagcggattctggagctgaatgtggagcacccagctttccaggccctggaggccgccgtgacagcggacccggagaaggccaaaaagtacgccacgctgctgtacgaccaggctctgctgatcgcaggtctgcccctggaggatccctccggctacactgatctggtgtgcgagctgatgaaataaaataccatgcgcaaaagcggtcccgggtaaaacccgggaccgcttgtttgatttgcttcaggacggatctctctgccatcccggcgttttttccatcgggtaggggcggccgccctcggccacccgagaagacagccgcgtggatcggtaccgccctcaccgccgctccaccagccgctggtagtgcttgtacagggcggaaaaccggccctgatagctgtggttccagggcttgcgcttgccgcagaagtggaggatggccgtgtggtccatcacccagtccatgtcccgctccccttggctcagcagcaggtagcggtcaaaccgccgggcgtcgtagttccacaggctgtcgtccacccccaggatctgtccgccgtacaggccgttgagcacgtcctggtccggcagcagcagaatgtcggcgtgctcccgggcatagtcgaagatgtcacccggccggacctcccgccgcatggcggacagatccatcactagtacgccggagttgtagtaggcctccgcctcatagttctccagccgcagccggttcaccgggtctgtgatgcccgccagcagcccggtgtgggtggcggcggccatcaggtctccctccaggtccgtatcatacagggcccggacgggattgattaccagaatgtccgggtccagatacagcacccggtccagagaacgcggcagcagctccgccgccagcagccggtagtacatggcccgggtccagtaccgggccaccggcgcgtcggcgaacaggtccgccggcacctccaacgggtggatgcgcccccgaccggcgcagagctcctccagtgccgcccagtcctccggcagcaggccgtctccgatggcgtaaatctcaaaggtctcgccaggatcattccgcagcagagagcccagcatcacccgcaggggcgggagatagttgcggtccagtgtcaccagaatgttcatgtggtcaagccctccgatccgttggtccgggccgtgtcccggtaataggccaccagcaggtccaccaccgtcccgtaggagcggatgccgtcctcttggccgtagcccttcaaaatcgtgtcgtacaccttctggctggcatccgccgcagccccctcgaaggatgcccagtaggcgttattagatgccagatccgccagcaccgtgtccggaaggctgtcccggatggcctgccaggccgccggatccgcctggtacagggcgttgcccaggtggatgtaccccatcagccagccggagtattcgtacaccggatcgccgctggtggtggaggccagcaccgccaggaagttgcactcctgctccgaggcgatgccccgctggtgggacagctcgtgggcgatggtggaggggatcaggcaggcgggggcgtccacgttgatgttggactccccggtgaaagcaaagtagacgccggtgaagttcatggcgctcatgaccctggagaagaacatccgcttgggcgctcggtcctcaaattccaggaaggggaacaggtcctccgcgccctggtagatgtccgtgctcccggcaaagatctcgttcagagacgcattgaacgtccccgcctcatcccggggcacctggtcggctgtctgcgccagattttccgcgaaccacgcggtcaccgccgtcagatccgggagcgatacctcctccgcccggatgccggaccggtcctggaaggtgtccgtgtaatagcacaccccccacagcaggcaggtagcggcgcagacgctcagcccggcgcagaccgcccccagaaccgcgctgtaagcccggcgcttccgccgccctctggccctgactaccgccgtgatgttccataccacataggccagcgcgaggacggccgccaggacatacagcacctccatcacagagaaggagacccgatagcacaggctgcccagagatctccggatcggggcggatacaaatcgctccagggcgttcatccagtcccggtgctcccgggcgatccagaaggccgccagcaggaccaggtccgccagcagccagatgtgcagtttttggtgggacttgaaaaatgtcatgctcactccgctgccgccagcagctggcgggtatagtcgtctttcgggtggtcgaagatgtcatccactgttccctgctccacgatgcggccttctttcatcaccagcacccggtcgcagagctggtacaccacattcaggtcgtgggagataaagagatagctgagatccagctcccgccgcagcgtccgcagcaggtccaggatctgggcctggatggtcacgtccagggcggacaccggctcgtcggcaatgaggaaccggggccgctggatcagcgctgcagcaatggacacccgctgccgctgtccgccggagagttccgccggttttgccgccagacactcctccggcagacccacccggtccagcatctcccgcacccggcgcttgcgctccggggcgtcatacttgccgtagacccgcagcggctcctccagggtccactccaccgaataggcggggttcagcgcgctgtacgggtcctgaaagatcatctggggccgcttggtgtagtgaatcacctgcccctggtcgggcttcacaatgcccaggatggtcctggccagggtggattttccggtgccggactcgcccaccagacccaggatttccccatggcgcacatcaaaggtcacgtcgcggaggacctcctgataggggccgcggcggaagagcccgcggtcccggtatccgctggtgacgtgccggacggagagcaccagctcctgttcgctcatggcgtctcctccttccggtgccgggtgggaatggcggcgatgagccgctgggtgtatgggtgccggggatggcggaacaccgtctcgatgtccccctcctccaccagcacgccccgctgcatcaccgccgtgcgggtgcagagcttccgcaccacgttcaggttgtgggagatgaacagcatggagatgccggactcccggttcagctttttcaaaagctccaaaatctgggcctggatggtcacgtccagggcggtggtgggctcatccagcagcagcagcttgggccgtgccacgacggccgcggcgatcatggcccgctgcagcatcccgccggagagctcgtggggatacttccgatacacgcccgccgggtccggcagctccactgctgccagggccgccagggcctggtcccgccgcgcctcccgggagaggtctgtgtggatacgcagcacctcctccacctgggggccgatacgcatcagggggtccatgcagctctgcggctcctggaacaccacgccgatctccctcccctggacctgccgcagcagcgtgcggtctgcgtggagcagctccgcgccgtccagcaggatctccccggaaaagtcgcactgctttcggggcagcagtcccgccacgctcatggcggtgacagacttgccggagccggactcgcccaccagccccaggatctccccgtcgtggatggtcagggacacgcccgccacggcctcccgctgccgggtgtggaatttcacatgcagatctcggatctccagcatcaggacacccccccgttccggcgctgcaggccctcgccgatgagacccacgccgaagatcagcagcacgatggcgccgccggaacccagggcataccagggggcgctggtcagcatcccctgcgcctccgagagcatgtagcccagggaggcgtccggcggcgtgacgccgatgcccagatagctcatggaggcctccgccagcaccgcgttgttgaagccgatggtgatggccggcagcagcacctgcgtggtgttgggcaggatctgccgcaccaggatgcggccgctggaggcccccatcagccgggcgctcttcacataattcacgtcccgcagcgccgcgaaggcggtgcgggtcacccgggcaaagctggggatgaacacgatccccagggcgatcaccacgttgtatttattccccggccccaggatgctgatgagaaccagggccagcaggatgctgggaaaggcggtcagcgcgtcattcaggcgcatcaggacctcgtccaccacgccgccgaaatagcccgtgagggcgcccgctgccgtgccgcacaccgcgccgatggccacggtgctcagggcgatcaggaaggtggtgcccgccccctgcagcacccggctgaagatgtcccggccgaagctgtcggtccccagccagtgggccagggaggggccctccagcttgggccctgccagcagggcgtccgggtcgtagggcgtccacaccaggccgaccaggatcagcgccgccatgaggccggtgacaatcagcccggccagcaggtatccgttcatccgccgcttcatgacgcacctcccagccgcaggcgggggtcgatccgctggttgacaatgtctgccacggtgcctgccagcaccacccagaaggccaggatcaccacgatggcctgcaccacggggtagtcccggttggagatggaggccaccagcagccgtcccagccccgggatggcaaacacctgctccaccacgatgccagccgccacgatctccgccatggtctgggccaggaaggtcaccaccggcaccagggcgttgcgcagcacatggcgccgcaggaccgccccccggtcattgccccgggagatggcggtgcggacatagtcccgccgcatctccccctgaatggtgctgcggagcatccgcacggtcatggcgatccgggggatggcgatggccgcagccgcgaaaaacagataccggaacgccccggtcgggtccgcacccagatccgggaattggccgtggacaaaccagcggagggtgatgctgaacagccaggaaatcaggatgccggtgaaaaacggcggcaccgccatgcacagctggtccaacaccgtccccacggcgtctcccaccctgctgtgcccgcgggaggcccacagccccaggggaatggacaccacggcaatcagcgcgaagctgagaaggctcaggcacagggtaatccccaccttgggggcaatcagctcccacaccggctggctataactgtaagaaatccccaggtccccggtgaaaaagcccgccagccactccagataccgcaccgcgaaggggcggtccagccccagctccgcctccagctccgccacgcgctccggcgtggcctgggtgcccagcatgatctccgccgcactgccgtggatcaattcaaaggccgcaaacgccagaagggagacgatgaccatggtgaccagcagcatcaaaatccgcttgcatacgtacttcatggcatcatctcccttccggggcagcggcagcatacctgccgcgcattggatttactgggcgtaatggaccgtggacaggtccatcacatagatgggatagaactggtatccctccagcccgttccgcagaaccaccaggtccgccaggtcctggatgtagacattggcggcgtgttccgtcaggttccgctccatctgtttgtagagctctgtctgctctgcgtcgtcggccgtggcctgggcctgctggaacagggcgtcatagtccgtgttctgatagttgataaagttgtcgtccgccgcagaggtgaaccgctccagcagcgcccgggcagtcatgttggaggcgtctacgcctaccacggtggactggaactgccggtttccgtacacctcgctgagccaggcaccccactccacaggctgaatctccgcggtgatgcccacggccttcagctgctccaccagcacagtggccgtgtcgatgtggggctgatagttggaggggacggtgatggtcatggagaacccgtcgggatacccggcctccgccagcagctccctggcccgctccgggtcatagggataatagtctgtcaggtcctccacaaaatatttctgaaacgccgggtacatactggagccgatggggctgccgtacccgtcgaaggccacatcgatgatctgctgtttgtccacggcgtagcacagggcctgccggaccttttcattgttgaaaggctccgcggcgttgttcagatacagcgcctgcaccagattcatcgtgccttccagcacctggaagtcatcccccagctgggcggcctgggtgctggtcaggtgggcgaacatgtcgatggctccgctctgcaggctcattaccaggctgtccgcgttctcaatgatccggaaggtcaccttgtccagctgggccggggtgccccagtagccgtcaaaccgctccagaacgatggagtcctgggctgtccgggagacgaatttgaaaggccccgtgcccaccggggcggtggcctggtccgtatagtcctccggcaggatggccagagtcagataggataaaaactcgctgtccggctgatccagggtaatggtcagcgtggtgtcatcagcctggatgctggaaatagcagaaagcgccgggatcagaggcgttccctccgaatcgtcggcgcagcgttcgatggaatatgtgacatcccgcatctctaccgggtccccgttgtggaactgcacaccctcccgcagggtaaaggtgtatgtggtctgatcctcagagatctcgtaatggtcagcgaccgcgggcaccaggtctccgtcaggcgtgggcttcaccaagccctcaaatacgttgaacatgacttccttggttcctgccgccaccgccaggtgagggtcaagactctcgtccaggtcctgcgcgatgcccaccacgatctcgttcgcctgggcccgcgcctcggtagagccgtccgctgtctgtccatcctctgacgcctgctctgtgctgccgcctccgcaaccggtgagtgcggcgctcaggaggcccgtcagaagaaggagcgccataagcctcttcttcatggttctctcctttgcatcactgctcatttcgagtcagtgttgggcggaaactgtccgccctgacagaaatgttcggctctattcaattttaaaaggagcctcacagggcatgttatttttataacgcttgccctgcaagggtgtattgtacacgaacgccccggggattgcaagggctttcgcaaaaaaacagcctgttcgggggagaaacattcacaaatccgtcacacctgcggaattgaatttccgggggcggcgtgctatactaatttacatcgctttggatggggccgcccatcccagtcaggaggtgtcactcttgaaaacgaagaaactgctgttcattctcaatccccgggccgggcggaacaagccccacggtccgctgtttgacgcgctggccatcctctccggcgcgggttacctcatccggatccacgagacctccgccccaggagacgcggccgataccgccgcccgggagggcgccggatacgatctggtggtggcagccggaggagacggcaccctcaacgaggtgatctccggcctgatgcggctggatgccccgccgcccctgggctatctcccccagggaaccaccaacgacttcgcctccagcctccagattccacggaccccggcgtccgccgcgaaaaacattgtacagaaccgcatgcgggaactggacatcggccggtggaatgagcggagcttcatctatgtggcctccttcggcgccttcacccgcagttcctatgccgcctctcaggcggccaagaacgccctgggccactttgcctatattctggaggggatgaaggacctgaacaccctccgcccctatcacatccgcctcaccgctgacggagaggtgctggacggggactacctgttcggcgccgtgtgcaactccacctccatcggcgggctgatgaagctggacccggagcgggtggtgctggatgacgggaaattcgagatgctgctggtccccagccccaagacagccgcggatctgcagaatctggtgctggcgctgctgaaccagcagtatgacagccagggcctggtgttccgccacgtctcctccctccggctggagacagaggaggagctgccctggtccctggacggagagtatgcccccagcgtgccggtggtggacattgtcaatcgacagcgggcgctgaggatgctgttatgagagacttggaacatctgcgtcgccggtacgcagaccatgtgccggggcttctgggcgcccggcacagctatgccgtcctctgtcccctggtggagcggccggacggcctgcacctgctcttcgaggtccgctccgccgccctgcaccgccagcccggggaggtgtgtttccccgggggccggatggaggcgggggagacgccggagcagtgcgccctccgggagacggaggaggaactggccatcccccgtcaggaggtggaggtcctgggcaggccggacttcatctgcaatcaggcgggctttctgatgcagccggtgctgggactggtctcggccgccggttttgcggcggtggcgccctcccctgcggaggtgggagaggcattcaccgtccccctggctttttttcgggagaccgctccggagcagtatgtctatgccctgcagccggacgtgccgggggactttccctatgagaccgtggggattcctgcggactaccgctgggcccggggccgggtggaggtccccatctggtattggcagggccacgccgtctggggtatgaccgcccgcctgacccaggacatcgtccgccacctggaataaagagcacaggcagggccggagcattcgctccggccctgcctgtttagaatggaggatttatgtgcccagaaactccgggtcatatccgatgaacttttcccacgccggcccgtccgccgccggagaaaagccgaactcccggtaaaagcccgccgcagcctccgtctccggcgtgggcagccgcaggcggtcccggcccatggggcgatagtgcatcactgcctggccgatcagctgcacgccgtaaccccggcgccgccagggctctgccactgccagcagggggatccagccgcagccccgctccgattcccggccgtcgtcaaaggccaccgcgcccacaggcgttccatccagataccccgccagtacaggcgccccggcggacagtgccccggaggtccccgcccacgccgccggaaactccgcctgctcccgcgccagggggcggaaatagaggccgggctccagtccgttggcccgctgcttcacggtgcatccttgggtgaaggccgggtctgtcagatggctcgcatcgtcccgccagaccacctggatccgcgccccctccgcccgcagcagagagacagcggtgttgctgccggtgggcgtcttccccagctcctccagcgggatgccctgcagggccgccagcagcaggcggatggcgcagccatgagagaacaccgccgccgtttttccgtcattggccgccgcaatgtcccgcacggccgccagcagccgggtctggactgcctggggcgtctccgcgccctctacgtgccacaggtggagccggtggttgaagttttccagctgcgccgggtcctgccgggcgatctctccccaggtcttctcctcccacacgcccacgcagatctcccgcaggtcccgccgccggtgcaggggcaggcccttgggcttgtatatggcgctggcggtggcgcaggtgcggtagaggtcgctggcgtagaccgcgtcgatgggaatatccgcgaatcggcgcgccagcgcctggatctgccgctcgccccggtctgtgatgctgctgttggcctgtccctgggcgatgcggtacaggttgccctccgcctctgcgtggcgaatcagatagatggtggtcatggtttcctccgtccgggcctgggcccgccgttttgagatttggatgtcgttatcatcattataacggatctgccggtttctggcaaatcgctctaacgcgtttttttccgggaaagcggctatactacgctcaggccgcaaaggagtgactgaagatgagaatgtgtaccggattttgggtcggtatcggcgccggactgatggccggcgcggcagtgggaatgatgatgccctacggcagggatcccatgaaaacgcaggtgggaaagagtatccacaagctgggtgtcgccgtggaccatgccgtggacagcatcgtttccgaaatgcgctgacgcgcagggcggggagcctcggctctccgccttttttgataaaatcgtttttggggcttgactttgggaaaagctctggtataataataacgctgtcgcatttggcgacgcctcgtatacagaaattagaaccagaacagctatggagaagtcgcctagttggtcgagggcgcatgattggaaatcatgtaggcccctaaagggtctcgagggttcgaatccctccttctccgccacagaaagccttggaaccgtcaggtttcaaggctttccttttttgcgtcctgcaagcgttttcgccgcaggaaaaccccttggcggaacgaaagagagacatctgcttttagcagatgtctctctttcatggcaaggggtaacaatccaaatcctctcaggtcggtcgaactctcttgcattcaaatttgcaatttttcttgagaagcatctaaccggccttctggccggcagcgcctttgcgccgtacaagcgttttaccacaggcaaaaccttggcgcagggcgaattcacttcgcccgagcatttcaatcactgaagggtggagcgaccaacgggagcgaaacccaaaagaaaatgcgacttgtcgaaacaagtcgcattttcttttggagcggctgatgggagtcgaacccacctatgcagcttgggaagctgccgttctaccgatgaactacagccgcatctgagttgttattataccagaccgcttcatattttgcaacccccaaatcttctccggcatgaacgccttttcgcggacatagattctaccatcgaagcaaagggggatcaccatgaaaaaactcgtcgtgctgctgtgcgccctgctggcgctggggagcagtgcccaggcgctggaagtatccgcgccctcggctctgctgatggaaaaggagacgggcaccgtcctcttcgccaaggacgaacatgccaagctggagcccgccagcgtcaccaaggtcatgacgctgctgctgaccatggaggccatcgacgccggacagctccactatgacgacgtggtcaccgcgtcggcccacgcctgctccatgggcggcagccagatctggctgaaggagaatgagcagatgacggtcagcgatatgctgaaggcggtgtgcgttgtctctgccaacgactgcgccgtggcgctggcggagacggtggccggcagcgaggaggcctttgtggagcgaatgaaccagcgggccgcggagttgggcatggccgatacccacttctgcaatgccaccggcctgccggcggaggggcatgtcacctccgcatacgacatcgcccttatgagccgggaactgatccgaaaccacccggacatccgccagtacaccaccatctggatggattccctgcgggacggagcctcctccctggtgaacaccaaccgcctgatccgcttctaccagggagccaccggcctgaagaccggctcaacagacagtgcgctgtactgcctctctggtacggccgagcgggacggcatggaactgatcgccgtcatcatgaaggcaccaacctccacccagcggtttgaggatgccaccaatctgctgaactacggcttttccacctacacgctggagaatgtggtgccggagtccgccctgccgccggtgcccgtgtccctggggacccaggccacagtgcagccggtgctgggggagaacacgcacctcctgctggaaaaggccaaggcgggcagcctgcagcagctggtcaccctggcggactctgtggaggcgccggtggcggcgggcagtcaactggggaccctcaccatcacctccggggaagaggtcgtggcggagctgcccatcctggcaggagaggagatcccacgggtcaccttcggccagatgctggtccagatgctgcggacggccttcctctgcggctgacggcggcggggggcgctgcaccccctgaaatcccggcggattgcgaccgctttcccttgtgtcccgtttcggggcatggtataataaggcaacaaacccgcgcagctttacgaaagagaggccggtcatgatgctggatgtcaaatcgttccaattacagtcttttctgcccctgccctatgaggaggtcctggcgccgcggctgaagcgggcccatgagaagctccagagcggcagcggtgccggcggagagttcaccggctgggtccatctgccccgggactatgaccgggaggagttcgcccgcatccaggcggccgcgtcccggatccgggccaactcccaggccctggtggtcatcgggatcggcggctcgtacttaggcgcccggggtgtcatcgactgcctgcgctctcccaattacaacctgaagcgcaaggatacgcccaacatctactttgtgggcaacggcctttcctccgacgccatgggggaggtgctggacctggtggcggacgtggatttctccgtcaacgtgatctccaagtcgggcaccaccaccgaacccgccgtggccttccgcttcttccgggcggccttggagaagaagtacggccgggagggtgcccgggagcggatctacgccaccacggacaaggcccggggcgccctgaagtccctggcggacagcgagggatgggagaccttcgtggtccccgacgacgtgggcggccgatacagcgtgttgaccgccgtgggcctgctgcccatcgccgtggccggggtggatatcaccgccctgatgcagggagcggcggagatgatggagacctgcaccgaggcttccttccggtgccctgcctggcggtacgccgccatccggtacgagctgtaccgggcgggccggtccattgagctcttggcctgctatgacccggcgttccggttcatggcggagtggtggaagcagctcttcggtgagagcgagggcaaggagggcaagggcctcttccccgccagcgtggagttcactgcggacctccactccatgggccagtacatccaggagggcaagcgcctgatgtttgagaccgtggtgcgcctgggtccctccgaccgacagctgacagtcccggcggacgaggcggacggcgacgggctgaacttcctggcgggcaagtccctggacttcatccgggaccgggccatggagggcaccctgctggcccacacggagggcggcgtgcccaacctgatcgtggagacctccggcaggacgccggcagacctggggcagctgatctactttttcgagtacgcctgcggcctctccggctatctgctggacgtgaaccccttcgatcagccgggggtggaggcctacaagaagaatatgttcgccctgcttggcaagccgggctatgaggaccggcgggcgcagctggagagcaagctggaggggtgaccagcctcggattgggcggcatccgtcctgccgcccactgtcaatctccattatgaacaaagtttgaatcttcatttctccattgtttttcacgcgatcttgtggtatgcttaacataccgaatttcccccagcgactttaattgacaggagtgattactatggtcagactgattatgggcgtgaagggctccggcaagaccaagcagctcattgaactgatcaacaacgcggcgaaggacgagcccggcaacgtggtttgcatcgaggctaaccgcaccatgacatacgatatccactaccacatccgcctgatcgacgcccaggagtacaatctggacagctacgagctcttccggggcttcatcagcggcctgtatgcgggcaactatgatatctcccatgtgttcatcgacaacctgtgcaagaccatcggccgggaagtggacaaggacaccgagaatttcctgaactggctggacgcctttggcgagaagaacaacatcaagttcaccgtcaccatcagcgccgacctctccctggctactgacgggatgcagaagttcctgtaaggctgctgcgctttcccatatacacagacgccgcctctgccaactggcagaggcggcgtttttcaggtttcagatttgcacctgggaggatccggcgtccagcccctccagcagattgtaattatcatagtccgccacagaggacaggtcgctgaggcacagctggtccacgccgaagaaagcagccatccgggcccgctccagggcggcctcgccgttgagataccacaccgcggtgtccccgctgccggaggtgagataggcgcaggcgtagcggtcggagtagtaatctttcgtctgggaggcggacagcagctgctcgatctcggcggcggaggcctggccgatgtgccgcccatccgtccaggcggagcccgtggtggtcagcagcaggctgagacaatcggaatccacctggtccgccagttcggccagggcgtagtagacctcctccaacggcgccaggggggcgatggggaagtcctcggacacgtcgccatagtccgccacccgtaccaccagcttgtcggccggctcactcagggcggcatagtcatagccgttgtatgcggctccctgccagacgggcgcctccaccatcaaatagagcagccggtcctctcccagttcggcccgcagcgcctccgccagcgcggtgaaatccttcttctgggcggaagagagctccgccaggtccagaaacagcccctcataaccgccgctctccaccgcggccgccagtacctctgcggtgtggctggggtcatccttcagtgccgaggcgctcccgcccacatgcagcagcggcacggcaccggcggcggtgatggtctcctgcagggcggctgcggtctctgcatcgggggtaccggcgagccgggactccccggcgtagatcagccgggcgccgcccaccgccacggcgccatagccggtcaggtctgtcagaccctccgcggaataggcgatgccggttttctccggggccgcggcgtgatagctgtcatacagccggatcagcatgaccgccgcctgctcccgggtggcagtctgatccggggagaaggtggtggccgcagtgccgttcaccagccccagctcatgggccatggcgatatagcccacgttggtggtcacatctcggaagggcatgggcaggtcctgggccaaaccggcgatggtgccgtagcccatagcccgcaccagcatgaccgccagctcctcccgggtgatgggctcccgggggcggaacgtatccgtctgccgggtgatggccccgttggcataggcggtctccaccgcgctgtaataccaggcactcttgtcctggttgtccgtataggacccggcctccggtgttaccatctcccagccgaacaggcggcacagggccaccacaaaggccccccgggtcatgggagcccccaagccgaagcgggtgggcgtctgcccctggaacaggcccaggtccacggcccgacggatggagtccgccgcccagtggctctccggcacgtcggaaaagccggtggaggccgctgccgcgggcgccggcagcgccgctgtcaccagcagggcgcagagcagcgcgcaggaacagaaccattgcagtcgtcttttcatgttgtcattcttcgctcctttagcgtcagatttctttcagattctggcagagatgcccggattcgccctctgtcggtatgccattgtaccagaatctgccgccgccgtcaaacgaacggtgtcggaacgcagaaaaacctttacgtttcaccccttgcctgctataataatttagttatgatggctttttattacctttgaaagggagggaacgtgccatgagattcaaaaaatggaacatcgggaccccggctgagcgggacgttgccctcctgcggagtgccggatacccctatctcctctccacggtcctggcggcccggggtgtcaccactgccgaggcggcggccgaggcgctggagcgggacaggagcctcagcatgtcccccatgctgatgcgggatatggacaaagccgtcgcccgcatccagcgggcgatcagccagggggagaccatcgccgtgttcggcgactacgacgtggacggcatcacttccacggttctgctgatggactatctcaaaagctgcggcgtccgctgcctgcggcatatcccccgccggatcgaggagggctatggcctgtccaaggaggccatccaaggcctgcgggaccagggcgccacgctgatgatcaccgtggactgcggcatcaccggcaacgaggaggtggacttcgctgcctccatcgggctggatgtggtcatcaccgaccatcatgagtgcaaggaggagctgccgcgggcgctggcagtggtggacccccaccgcagcgactgcccctatcccttcaagcatctggcgggagtgggtgtggcgctgaagctggtgctggccctgggggcgagagccgggaggatgccctgttcgcccgatactgcaccctggcggccattggcaccattgccgacgtgatgcggatggagggggagaaccgcaccatcgccttctgcgggctggaggccctgccccacacggacttcgtgggcgtccacgccctgctgaaggaggcggggcttctgggcaagcccatcacctctgtccagatcggctttgtgctggccccccggatcaacgccgccggccgcatgggcgcggcggatctggccgcggacctgctggagaccgatgaccccgcccgggccgaggagctggcaaaggctctgtgtgacctaaaccgggagcggcaggcggtagagcaggccatctgcgccgacgccaccgagaagatcgagcgcctccgggccgaggaccgcagcgccctggtcctctccagcgaggactggcaccagggcgtggtggggattgtggcctcccgcctcagcgagaagtacgcctgcccaagcttcatgattcatctgaaagacggcgtgggcaagggttcctgccggtcctacggcgggttcaacctgttttccgcgctggagtcctgcgccgacctgctggagggcttcggcggccacgagttggcggcgggctttaccatctccgaggagaacatcgacgccttccgggcccggatgaaccggtatgtccgctccgcctccggcggggaacgggcggtatcctgcctggacgtggacgcgcccatctcctgccccggcgaggtgacgctggcggaggtggagcagctggaccagctggagccctatggcgcgggtaatccccggccggtgttcgccctgctgggcgccacggtggacgtcctgcagcccgtgggccaggggaagcacctgaagctccgcctctccaagggcacgtgccggtttgacgccatcttcttctccatgacggaggagacgtgcggcgtggcggcgggcatgcgggtggacgcggccttttatctccaggccaataccttccggggcaataccaccctgcagctgcagctcatcgacatccgcccctctctgacccccagccgccatgaggcggcggacctggacctgctccaccgcctcgtggcgggagagggcctcaccgggcaggagcgggcccggctccaggcgtcccgcagccagttcgccgccttttggaccgtgctggagcggcagctccgccggggaaaggcggaggaggagatgctgccctttctgcggcggctgtcggcactctccggcgggtgtgagagcttcctccgggccggcctggccctggccgtgttccaggagcggggcctgatcgccctgtccgtccagggggaccaggtgacgctttcgctgaatcccatccaggggaaggtggatctcttcgcctgcccctatctgtcccgcctgcgggaggacgccgccggcaagagtggaggtgttgtgtcatgaccattcaggaacagtatgagaacctggaaaagactgtccggggctacaatcctgcggcagacttccagcacatccgggcggcctttgaatttgcggcagaggcccacaaggaccagaagcgcaagagcggggagccctatatcatccatcccctggcggtggcgcagattgtggcggaggagctgcggctggacagcgagtccatcgaggccgccctgctccacgacgtcatcgaggacaccgccgccacccacgaacaggtatccaaactcttttcacccaccatcgccgacctggtggaaggcgtcagcaagctgacccgcatccagtacgccaccaaggaagacgagcagatggagaacctgcggaagatgctcatcgccatgagcaaggacatccgggtgatcctcatcaagatctccgaccggctccacaacatgcggaccatggagtaccagtctcccgccaagcagaagcagaagtctctggagactatggagatctacgcccccatcgcccaccggctgggtatgcagcgcatcaagtgggagctggaggacctgtccttaaaatatctggaccccattggctacgaggaaatcgtctccaagctggaggccaagcaccaggagtacgaggacttcatgcgccgcatccagatccagatcgacgaccggctgaaggagctggacatcgatcacatcgtctacggccggatgaagcatccctactccatctaccggaagatgttcaaccagaacaagagcctggacgagatcttcgacctgttcgccttccgggtgatcgtgaacacggtgggggactgctacaacgttttgggtgtcatccatgatctctacaagcccattctgggccgcttcaaggactatatcggcactccaaagcccaacggatatcagtccctccacaccacggtcatcggcgcggacggcctgcccttcgaggtgcagatccgcaccaaggagatgcacgagatcgccgagtacggcgtggccgcccactggaaatacaagcagaacggccagggcgccggcaccgaagggcgctacgagtgggtccgccgtttgctggaaaaccaggagggcgcggacgcagaggactatatccactctctgaagatcgatatgttctccgatgaggtgttcgtcttcacaccgggcggcgacgtgcagaacctgcccgccggcgccacgcccatcgactttgcctacgccatccactccgccgtgggcaaccggatggtgggcgccaaggtgaacggccggatcgtcacgctggaccatgtgctgaaaaacggcgacatcgtggagatcctcacctccaagaacgccaagggtcccagccgggactggatgaagattgccagaagcagcgaggcccgcagcaagattcgccagtggttcaagaaggagaagaaagaggagaacatcgcaaacggccgtgccgccttcgaggcggagctgaagcactgcggcatctccatgaaggacgttctctcgccggagatgctgccggtgctgttgaagcgggtgtcctacggctctctggacgacatgtacgccgccatcggctacggcggcttcaccgcccagaaggcagtgagccggatccagggggagctgaaccgggtggcgaagctccaccaggcggaaaaggccgccgaggagctggcggaggccaaaccggcggagcctgccaaacagccctccgctcccaagcgggtgaagagcgagcagggcatcatcgtggagggcctggataactgcctggtgaagttctccaagtgctgcaccccggtgccgggggacgacatcatcggctttatcacccggggtacggcgtgtccgtccaccggtgcgactgtcccaacgcctcggaggagaagcgatcccagccggggcaggaggggcgctggatcaaggtctcctggggcggcgacaccaacgacagctatcccacgattttggaggtggtgtgcaaggaccggcagggcctgctgctggacatctccgctgccctctccacgacgaatacctttgtgctgggcatcaactcccgcagtacagaggaccagtttgccatcttccggctggagatccgggtgaaggacggcgcccagctgaagtccgtcatgaacaagctgaaccagatctccggggtgctgaaggtcaaccgaccggcggggtgagagcggcttccgccggggtgattcgatggcggaagagcttccggggggatgtaggggcggcgatcaaccgcccggagatgatttgggccgccgaacggcggccacgggggattctgctcccgcagggggccgcttccacgggggatgcgccccccattgtcgtcgtcgcaaagtccgctcagctccgtttccgcctgcggcgaaaactgcgcccgctcccttgctcctcctctccccaccgcgcggggcgcggcgggggcccctttcggtcttgccaaaagagaaatgggccgtgcacggtctaaagagaaaagtgtgtggcgcgctgcggtgcagtggccctccgcgctgacggaggtcgacgtatcggtgcaagcgccgattttggcccgccttcgggcacgcttgggccttctgcgattttcctaactgccgtcccatggcgggagtaccaaccttgtcggggtggttatcgcatggaattgcttctcttttcgctgccgctggctgcccctcgggggaactggcgtagcgggccgataaaggcatcggcccctacggagataccgtcggccttgcgcattttgtgggggccgacctgcgtgtcggcccttgcgagggtgacgaaggccacaagcccggtaggggcggacgcccttgtccgcccgccagcacaagccgccacaaccgcccaggcagcgcgtagcgactgcgcagctgttggtggctctgccgtcttacggatgcggcgtgctccctgcgggcaagcggaacgcgcggaaggaggagccagtggaacactggtgacggaaatacggggagcgccgcagcgcgagacaggaaaagaggagcggttcaaatgcgcccgtgtcctccaatccaagacgcactacgccgcgggaatccgccgctaagtctgcaccgcaccccgccgcgcccgtcgggggaccctcgcaaacacgcaggcaccctctcgcgccgccccccgtacagcaactttgcacgcatgtgtaaagttgcggccaaagcgcctttttctcttataccgggcgcggcgcgttctctttttggcgctgacaaaaagagaatgggggcgcatctgcacggccgtcagcatggctgatattccccgcagaaatagaagccttccattttgagtgaaccatagaaaggaatccattgtatgcgtgcagttgtgacacgggtggctggtgcctccgtaaccattgccgggaacgtcaacggccggatcggccgtggcttcctggtgctgctgggcgtgggacccaacgacaccgaggagaccgccgaccgcctggcggagaaaatctgcaacctgcgggtctttgaggatgaaaacggcaaaatgaatctgaatctggagcagacaggcggtgccctgctggtggtgtcccagttcaccctgtacgcggacacctcctcccgccgccccggctttaccggcgccgccaagccggacgcggccatccccctgtatgagcgattcatggctcactgcagggagcggggcttcgacgttcagcatggggagttcggcgctgatatgcaggtggactcccggaacgacggccccgtcaccatcctcttcgacacagagcggcccttatgagggaagcggcgcagggcggcggcgaaatggcgccgccggagctggtgcggacgttctatgagaccgtggtctcccagcaccgtctggaggacctgccccgcttcgtcgaggagggctgcgtgctccgccagggggagtggaccactcccctgggtcccggcggcatggtgcggcatctggcggctctgcgggagacgtatccggattacacggtccgcatcctccgccagcactgggccgcgccgtatgtcgtctccgagtgtgttatggaggggacccacctgggcccttggcccggaacagtccccacgggaaaacgcctgatcttcaccggcgtgaacatcgaccgggtggagggcggaaagatcgtggagcacggcggcgctgtgaacacctttgagaccctgtgggacgcgggcatgatccgccctgcggagtgacagggcatttgtccattccacacatgggcgggcgggatttccgccgcctgcctctgatattttcatttggcaagggaggtctcccatgaagatcaagtgcttgcaggtgggccccatcggcaccaactgctatctcctctgcgacgaggatgccaagacctgcgccgtcattgatcccggcggggatggggcgcggatcgccgccgcggtggcggaaaccggctgtgtgccctgcgccatcctgctgacccacggccactacgaccacaccggcgctgtgggagagctccaggccaaatggccggagaccccggtgtatctgaatcgccgggatgtgtacgccgatgcctgcacccagcagctgttcccgctcctcagcggggacgtgcgggactacgacgagggggacacggtggctgtgggcggcctgacggtgaccgttctggccacccccggccacagcgaggggtctgtcaccctccggtgccaagacgccctcttctgcggggatacgctctttgcgggctcctgcggccggacggacttccccggcgggtccatggagaagatgatggcctctctgcggcggctggggcagctggagggagacctccgggtcctgcccggccacatggaggcatccaccctggaccgggagcggcgctggaacccctatctgctccaggccatgcagtgaggagggcgcgcccatgaaactggttttccgcggccatgacgagcggtatgtggtggagcagagcctgatgaatctgttccccggggaactgcctgtctacgagccgatcaccccaggcgatgacagctgggccgtgatctcgctggaggagacgggggacctctgccgggtggcggtctccctctgccggggcggcaagaccaccgagcagacctatcaggagcccctctccggcggcgatttccagcgggagggcctccgccgccacgccgtcggcgcctgcttcttcctggtggcccgggcggtcaccggcgtgacgcccccctggggaatgctcaccggcgtccggcccgacaagccggtgacctgggccctggaggacgggaagtccccggaagaggcccgggcgtatttggaggagcactatttcgtcaccccctcccgggccgccctggccctggagaccggcgccaccgcggccaaggccgcccggcggctggagaagcgggacattgacgtgtacgtgggcattcccttctgcccaacccggtgcgcctattgctcctttgtcagccagtcggtggagcggagctttgccctggtgcccccttatgtggacgccctgtgtggggagatctccgccggcggcgagatggttcgccgggcgggactgcgggtgcggaccttctacatgggcggcggcacccccaccaccctgacggcggagcagatggaccgggtcctcactgctttcgagacctccttcgaccgtaccgcctgtgaggagatcactgtggaggcgggccggccggacaccatcacggcggaaaagctggtggtgctccgcacccacggggtcacccgggtctcggtgaacccccagacctttgaagagaacgtgctgcgggccatcggccggtgccacacggctgcggacatcgaccgcgccatggagctggtggcccggtgcggcttcccccacgtgaacatggacctgatcgccggactcccggaggatacggcggagggcttccgccgctccctggaccggtgcctgacctacggccccgacgatatcaccgtccacaccctggcgctgaaaaagggcagccgcatcctgacggagggactgcggatccccggcgcggagacggtggccgagatgctggattacgcctctcccaccctccggaccgccggataccgtccctactacctataccggcagaagtacatgtccggcagctttgagaacatcggctggtgccgcagcggcggcgagtgctggtacaacgtggacatcatgtcggagctgtgctccatcctgtccttcggcgccgccgggtccaccaagatggtggtgccgggcaccaaccagatccagcgggcgttcaacgtgaaatatcccaccgagtatatccagcggccggagaagtggcaggccaatcagaccgccttcgccgccttttatgaagcactgtgaaaggagcatcgccatggcctattccctgaaagagatcaacgacgctgtccgctctgaccccaagggctttgcggaggcgtgcgacgccgcctttgccaaaaaagtggagacggcggcccagaagattgccgatcaccggaaggagtcccgcatcatcctgttgtccggcccctccggctccggcaagaccaccacggcattgaagatcgaagagcagctggagaaaatgggcatccagacccacaccatctccatggacaactacttcaacaccatcgacccggagacggcgccccggaaccgggagggcgccatcgactacgagtctcccttctgcctcgacatcgagctgctgaaccgacacttctccatgctggaccggggggagaccatccacgtgcccaagtacgagttcgcccgacagatgcgctccgacatcctgtctcagccgctgaagctggggcccgacgagctggctatctttgagggcatccacgccctgaacgacgtgatcgtgggcaagaatcccaaggccttcaagctgtatatcgcggcccggtccaatgtggtggacgaggacggcgccgtggtgttccagcacccctggctgcgcctgtgccgccggatcgtccgggactacaagttccggggcagcgacgccaacttcaccctgaagatgtggcccaatgtccgccggggggaaaagctgtatatctccccctataaggagaatgcggacttgatgttcgactcctccctgccggatgaggtggcggtgctgaagcccttcgtggtccccctgctggaggcgctgccccagggcaagtatgagatcgcggacgacatcctccggggatttgagcggatcgagatcatggaagagtccaacatcgcccccagctccctggtgcgggagttcatcggcggcagcatctatcccagctgagcggggctgcccctctgccccaatctttctttggaggtcatacaagccatgaatgagcggttgcaggaactgctggacgcggtgcagcgcactgcctcccaggtgggcggcagtgcggcggatgccgcctacggcatgggaaagcgggcgggagagctcctgtccgtggccaagctgaatatccggatcatggacctgaagggagcggtgagcaccgccctgcgggaggtgggggagatgatctacgccacccacaccggcaccctcacggagtccgaggtactgctggcaaagcttcaggagatcgacgggctccgccagcagatcgaccggctggagcgggagatcgctcggctccagggcggcgcggtgtgccccttctgcggggcggccgcccggagcggcgacgtattctgccgggaatgcggccaaaagctgtaaggaggaagcgtaagatggaatatacattcgcacaatatcaggagagcgcccaggcgctgagagaccgcctgggggcgttccgcccccggtgcctgctgatcttgggctccggcctgggctctttgggcaacgaagtggagtcccccattgccgtcccctatgaggatgtgccccacatgaagcgatccaccgccccggaccacgcgggccggttcgtgttcggccgcctggcgggtcaggacgtggcggtgatgcagggccgcctccacacctatgagggctggtcctttgaggatgtcagctatcccgtccgggtgctgcggctgctgggggcggaaacgctggtagtcaccaacgctgccggcacggtgaacaccgccttctccgccggggacatcatgctgattactgaccacatcaaactcttcggtgtcagccccctttgcggccccaatctggaggagttcggcccccggttcccggacatgagccatgtgtacacgccccgactccaggacaccgcccgggaggctgcggaggagctgtccatccccctgcgccagggcgtctatatgtacttccccggcccccagtacgaaacgccggcggaggtccgtgccgcccgggcgctgggcgcggacgccgtgggcatgtccacggtgccggaggccattgtggccgcccactgcggcatggatgtgctgggcttcacgctctgcaccaatatgggggccggggtgctggaccagcctctttcctccgacgaggtgcttgccgccgccgccacggcggggccccggttctctgccctggtaaaggcgtgtctggcccggttataaacggcagcggcaggccataggctcataggggcagcagattccgccgccctagttctctgttgtaatttgaggtaatcgcttcatgtctaatcaaaaaaagcaatccttcctgggcggcgccgccatcctggccgcagctgtcgttgtggtgaaatttatcgggttcttctacaaagtccccctgaacaacatcctgggcggccccggcaagacgtatttcgacactgcctataagatttacaatttcctgctgaccttctccacggcgggcctgcctctggccatctccaagctgaccagccaggcccatgcccagggacgggagaacgagaagcggaagatcttccgcaccgccatcgtgctgtttttcgtcctgggcacggtgggcgccctgtttatgttcttccaggcagagggcttggcggggtttctggagaacagcctggcggcccagcccatccgggcgctggctccggcggtgttctgcgtgtgcctgctggcctgcatgcggggctacacccagggccagggcaacatgacgcctacggcggtttcccaggtactggaggcgcttttgaaactggctatcggtctgccgctggcgtggtatgtactgcgcatcggcatgagcctggagatgggcgccgccgcggccatcctgggcgtcacggcgggcacggcggtctccatgctgtttttggtgggatatttggcgaagcaccggaatcggacacagtccctggatgtcccctccggcagcagccatctgatccggcagatcctggccattggcatccccatcaccctcagcaactccgcaatgagcatcctgaacatcatcgacaccaagatcgtcatgggccagctgcagaacgccctgctgctgtcggaggaatcggccgccgccctgaacggccagtacagcatggccatggatatgcccaacatggtggcctccttcgtgtacccggtgaccatgagcttgattccattcgcggcggcggctctggcccggcaggaccatgccggagcggaccggatcatctcctccgccttccgcatcatcgccattctggccctgccggcgggcatcggcctcagtgtcctctccacgcccatcatggtcctggtgctgccggcccagcgggaggatgccctggcggcgggcccccatcttcaggtgctgggcatcgccctcatcttcatctgcctgatgatcctgaccaacgctatcctgcagacctacggcaaggagaagctgcccatcttcaccgtgatcgtcggcggcatcgtcaagatcatcatgaactatttcctggtggggaatccggacatcaacatccacggcgcacccatctccacgctatgctgctatctggtgatcgtggtgctgaatctgttcttcgtgtggaaatactcgccccagaagccacggtatctcgaagttttcgcaaagcccgtggccgcttccctgctcatgggcggcgcggcctgggcggtctatggcctagccagccgggtgctggatggggctttcctcgccctggcacagcagatgtttgcggatccggataagatccagctctggtctgtatatctggccaacgccgcctgtgtcctgctgggcatcctggccggcgtgatcgtctacggtgtgctggtgatcgctctgcggatcctgcgggcggaggatgtgcggtccattccccgcggggaaaagcttattaaacttctgcacttaaaatgagaaaccgggcggccgcgcccccttcccaagggggcgatccgctaaaattccttgaaaaatcaggggtttcccgtgaatttttcttgcaaaggcaggcatcttatggtagagtttcagcgtaaggatttttacagctacgaggattttctggagatcatgcggctgctgcgggctcccgggggctgcccctgggaccgggagcagacccacagctccatccgccggaacttcctggaggagacctatgaggttctggacgccatcgaccacgacgacgccagcggcatgtgcgaggagctgggcgacgtgttgatgcaggtggccttccatgcccaaatcgaggcggagcggggccgcttcaccatggcaaatgtggtggacggcgtggcccggaagctggtgtaccgccatccccatgtctttggggacgtgcaggcggatacctcccagcaggtcctggccaactgggacgtgctgaagcgccgggagaagggccagcggtccacggcggacgcggtggaggccgtgccccacacgctgcctgccctgtggcgggcggaaaaaattcagtccaagaccgccaaggccggctttgactggacaagctctctccaggcactggacaagctggaagaggaggtccgtgagctccgggccgccctggaggccggtcaggccgccgatgcgccccacggcatccgggaggagctgggcgacacgctgtttatggccgccaaaatcgcccagatgtcgggcgtggacccggaggacgccctccaccgggcctgcgacaagtttgaccgccgcttccgcgcggtggaagaggccgcggacaagcctctgccggagtgcggtgaggcggagctgctggccctctggaacgatgcaaaatcccacgatccgtcttaatcgcgggcgcgcctgcctgcgttaggaataaatcatctagcaagcgcatcacacattgtataggaggataacatccatgaacaaagctgaactcatcaattctgtcgccgcttctgccgacgtttccaagaaggaggccgaggctgttgtgtccgccacgtttgacgccatcactgccgccctgaaagacggcgacaaggtgcagctggtgggctttggatccttcgaggtcaagaagcgtgccgcccgcgtgggccgcaaccccaagaccaaggagtccattgagatccccgcttctgtagtgcccgtgttcaaggccggcaaggccctgaaggacgccgtggcgaagtgatctgaccctgtgatttcgggactgccggtgctgtggtgccggcagtcccgtttcccatgagaaaggagccgcccatgcgtttggataaatatctcaaagtctcccgcctcatcaagcggcggactgtggccaacgaggcctgtgacaacggcctggtcaccgtcaacggcaagcctgcccgggcctcctacgacgtgaaggtgggggaccagatttccctgcgcttcggccagcgcatcgtaacggtggaggtgctggacgtccaggagacggtgcgccaggcggacgccggcacgctgtaccgggagatcggccggtaaggccggacgcatattctccccgcccctcccatatagttgggacagggagggacgcggaatgaacgactacaacaacgccatgtcccaggcgggccaccgtctggagctgatcggccgggagcggctcacggtctccggagtggaggacgtggagcggttcgacgagaccggcatcatcatgtccaccagcgtgggaacgctggtcattaccggagaggacctgcacatcggcaagctgtccctggacgggggcgagctccatgtggacggccggatcgattccgtctcctatgaggacggcggtcaggagcgggggggccttttccaccggctgttcgggtgaggcgccatggcccctgctctctcccagccgctcctgctcttctgtcaggcgatcctgctgggcatggctgcggcgctgctgtatgacctgctgcgggccttccgcctgcggctgccccgcctgacgtcggcgctggacatcctgtactgcatggccgcgggcttggcggtcttcctcttcatgctccgccgggcgcaggggcagctgcggctgtatctgctgctgggggcggtgggcggcggtgtgctgtttttcaccgccttctccccgtttttgcggccggtgtgggatttttgggtggataccctggcatttttgctgcatctgaccgccattcccctgcggggagcggaaaatttgtgtaaaaaaattggcagatggggaaaaaatctcttttattttattcgcaaatgttatacaataaaaaacaccaagcacggcagaaggctttacaaaggaggcgggcggcatggcaagagcaggacggcagccaaagaagcggtccagaggaagcgtcctcaccaagcttctgatcctggtgattctggcggcgatcggactgcagctgcgcagcctccacagccaggtgcaggacgcccaggcccagcgggacgccctgacggcccaggtccaggcccaggagcaggaaaacgccgccctggccgcggacatcgccgagggcgccaccgaggataagatgaaggagatcgcgcaggaagagctggggctgatctcccccaatcagcgtgtgttttctgtgggcaactgaccggagccgggcgacgagggaggcggagcgcctcccccgcttgtgccgggagccggtcttttttgatacgacccgcttccacgggagcgggaaaaccatccggaaggagaaacagtacactatatggagcttcaggtagggagcattttggaaggaaaggtgacctccatcaccaaattcggcgcgttcgtggccctggacaatgggaagtccggcctggtccacatctccgagatcgccaacacgtttgtcaacgacgtacatgactacctgcaggaggggcaggccgtcaaggtcctggtgctctccacggagaatggaaaggtcaatctctccatcaagcggacgctccccaggccggagcggcccgcccgcagtccccggcccagcggcagccacccggcggggacgtcccgtcccgtggcccaggcccggcccgccgcccgggcgcagcagccgctgcccccctccggcgaccagtcctttgaggacaagctgaagcagttcctctcctcctctgaggggaagatggccgacctgaaccgcagcctggacgggcggcggggcggcggccggcggcgcagataacaccagggcgcgcggcaatgccgcgcgcctttttcatgtccgccggataaaaaagggccgcccagcggtttcacgctgcgcggcccaagcgggtgggatattggaaagcttccgggattatcatacacccgccctgcatcccttgtaaataggagcttttgtcggatcggctcctcttttgtcggatcgctgcgggctctgaacaatttgtgaatttcaccggctcgccccttttcaaatggaaagatttgtgctatattaataaaaaggggagagatccccgatctctcccacacgaaaggagcgatccctatgaagtatacctttgcctgcaagagagtcccgctgaatgattccatcaaggaatatgcccagaagaagatctccaagctggagcgatacttccgggaggaggataccaccgcgtttgtcactttctctgtggagaaggaccatctgtgctcggtggagatcacgatccgcggcggcaccacgttgctgcgggcacagacggaggctcctgacggagatatgcgcggcgccattgacgccgctgtgggatatatcgagcggcagattctgaagaacaagacccgcctggccaagcgcctgcggactgagggcttccccccgcccgccccggcggacgactttgaggtggctgaggagaaggagttccccatcgtccgtaccaagcgcttctccgtgaagcccatgagtccggaggaggccatcctgcagatgaacctgctggaccacagttttttcgtgttccgcagcagtgaggatgacggcctatctatcgtctaccgccggaaaaatggcggatacggcctgatcgtcacggatgaagaggagtgacccgtacctggcagacagggcggagccgcgtcagcggctccgccctttttcgctccgccccggagatggcgcgcaatgcctcttgtccttttcggcatcttctgctatactgataccggcaaatccccgctatgggtcaaaatacgaggaaagaaagaacaatttgatgaagatgatttttttggtggacggcgacaacaacattggcaccgggctccagggtatcgacctgctgactgccgaggacaccgtcctggtctttttcggcaaggggcagaccctggccaacgtgaaaaagctgtgcgccggcacaaaggcccaggtgcagtatctggagagcgtgaagggaggcaagaactccctggacttccagatcatcacggagctgggcgtcctggtgggaagaggagaggcggatttcgcctatgtcatcagccaggacaagggatatgaggccgccatgagtgccctccacgcacgatacgcctccacgttccgggaggtggctctgcgcccctccattcaggactgtctccaggcggcgttcctgctgcgggcaggcactcgggaggagctggccgccgccctggcccggcagtacggccccgtgcagggtcagctggcctatgagcatctggaggccctgctcaccccgcctccggtccaggaggcggcggccccctcccccgcgccggaaaacaaggcggcgtccaagcccggaaagcggcgcagccgcgcggcggcgaagccggcggagaccgccgagcccgccccggcccagagcgccccacaggatgcggaggagcctgccgggacggcggagcctgccgccccggccgccagatcccgccgcagcggtgccagccgccgccggaagcgggcggagcggtccaaggcagaaaaagcatgacaagaggccgcgcctttggcgcggcctctttgaatccgccacagtgggcaacacggcgcccggccagtctggccgggcgccgtctgtcacgttgtctgctgttcgtccagggcccgcagcagggcctccacggtccgctccaccacccggaccgtctcttcgtcccggtcccgcagcagatccgtgatccgctgcacagcgtccccgggcgcgccgaagagcacatagtcggcgttcaaatccagcaggcggcacaggcggataaagttctccagccgggtgccggtgtttcccagctccaaatccgcaataaaggacacagatagatcggcccgctcggcaagcacttctctgctccagttgagtcgctctctggcttcccgaaagcggcgtcccatctctattctgtttgggtcacgttttctcataaaagcactgctcctgctgtttgagaaaagtgtaccctatttcccaataaagaaaaatatagtctagtactttattgacaacgtacaaagtactatgttaatatgaaaaaaataggacgcaggcagctgcccgcgccctaaaaagcgtattaccggctctggtccgctgtatgcatgtaggccatcagatccaggatcttgttggtgtagccccactcgttgtcataccaggcgatcagcttcacaaagttgttgtccagcatgatgccggcggtctcgtcgaagatgcaggtctctgaaaaccccgtcaggtcggaggacaccacctggtcgttggtgcaggtgatgatgcccttcatgctgttctgggcggcgttttccatggccacgcacacatcatgatagctggcaggctgcttgaggcgggcggtcaggtccaccacggacacgtcgttggtgggcacccggaagctcatgccggtcattttacccttcagctccggaattaccacgcccaccgccttggccgcgccggtggtggagggaatgatgttgcccaggacgctgcggccggtacgccagtcccggcccgcccgggcgtccacagccttctgcttggcggtggcggcgtggatggtggacatcagcgcctgctcgatgccgaaggtgtcgttgatgaccttagtcatgggggccaggcagttggtggtgcaggaggcgttggagaccacgtccatctccggggtgtaccgcttgtggttcactcccatgacaaaggtgggcgtgatgtcgtccttggccggggcggagatgatgacctttttcgccccgtgccggaagtgggcggaggccttttccgtggtgcagtaggcgcccgtggactcgatgatgtactcggcgccgcagtcgtcccaggggatgttggcggcgtcgtcttcactgtaaacccggatcttcttgccgttgataatcaggtgacggtcgtcccgctccaccgtgccctgaaaggtcttgaacacggagtcgtacttcacctgatagaccatgtagtccaggtccgcgttccgcaggttgatgccgcacatctgataggtggcgctgccgcgctccaccatgatccgcagtgccacgcggccgatccggccaaatccgttgattcccactttgatcgccatgttcccattccttcctgtattccgtattccgccgcagcggatgttgtcctcattataccatattaccggaaaatgtcaccgcaattttgcgtaaaattgcgcatataaaacgcaagatttgttgtccgttttgcacagactggacttctgttcggccgtgtctgccggacttcgacaattttccccctttttcgacaaagaccttgtctttgcatcccttttttgctatcctattggtgttcgaggcaggcttttccacggtttgaaagcccctccccgtatatgctacaagagagaatcccagctgaaaggatgcgcctatggaagcagagcaatttgacttctccgttgtgttccccaacatcgccgcccagttgcgcagcgtgttgggaaacctgcacttggcggccgcccagctggcgcctgccatccggcgggagggggatccggcgctggattccacagcttccctgctggatcagagctactaccgcctgctgcggctggtgaacaatctgacggcggcgggagagctggggcaggacgcgcccctccccgtccgggaccgggatttgacggagacggtccgtgcggtctgtgccggggctcagggtctgtttgcgctcaaaaaggtccagctggaattccggagcgctgcggactgccacacctgcgcttttcaccagccctccatcgagctgctgctctaccagttgctctccaatgccctgaagtttacccccgccggaggcgcggtgaccgtggagctgaaattcatcaaccgatgggtccgcctgtccgtgtccgacaccggctgcggtatccaggaggaccagatccccttcctgttcgaccgctaccttcacgacgatgcgatggcgccccagccccacggcctgggcctgggactgcctatctgccagcacatcgcagagcgccacggcggcaccatgattgccgagtcccggccggggcaggggtcccgcttcaccctgtcgttgccggaccggcgatgcgggactgcggacgtgtcggacgtgaagttcgattacaacggcggcttcaatccgctcctcctggccctggcggacgccttgccccccaggctttctcccagcgccatctggactgaccctggctccggctggggtcggtttttttcgcagaagcggctttccttttttccggaaatcggctacaatagccctatcacacgaccggcgctccgtcggccttttcaggaggaacccatttatgtcccagcgtgtatttgtggccatgagcggcggcgtggacagcgccgcagcggcgctgctgctgcggcaggccggctataatgtcaccggcgtgacgctgcgcctgcatccctataaggaccgcccgggcctgtgcggctctgcggatgatatcgagacagcccgcgccgtggccgccggcatggggattccccatgtggtgctggacctgtgcgatctgttccgcgagcgggtcatggaccggtttgtgtgggcctacacccacggccgcacacccaatccctgcattgactgcaaccgggagatcaagttcggcgccctgctggactgggcgctggaccagggcgcggacgccatggccaccggccattacgccagagtccgcctcgatacgccctccggccgctggcagctgctgcggggcgcggatcgacggaaggaccagacgtacttcctctatcagttgacccagcaccagctggcccatctgctgctgccggtgggagactatgaaaagcctgccctgcgggccctggcggccgccaacggcctgtccaacgcccagaaggccgacagccaggacatctgctttgtgccggatggggactatgtgtcgtttttgcggcagtatggcggcgtggagcccgtccccggtgacttcctggactcagaaggccgtgtgctgggccgccacaggggaatggaatgctataccatcggccagcggaaagggctgggcgtcagcgccaacgcgccgcagtacgtgctggggaaggacccggaccggaatgccgtgatcctaggggaggacaaccgcctctacacccgggagctgacggcggagcgggtgaactggctctccgtaccggagccggaccgccccctgtccgtcaccgccaagacccggtacagccagcgggaagctgccgccacagtggaaccgctgcccggcggccgcatccgcatggtgttcacagagcctcagcgggccgtcaccccggggcaggcggtggtgttctacgatggagatctggtgctgggcgggggcaccatctgtccgtgacgcaaaaggacgccgcgaaagcggcgtcctgcagttcttatcgctgactggtggtccagctgtcctgaaagatcaggtcatccacatccccgccgctgatcgtctggtgtctcatcattttatttcctcctttgcatttgggttctcagccagtatatgcgcctccgggcggaaaattgcacggaaacgggcacctgtctggactttttgcaacgggagttgtcgaaaaaatttgaaaggttttccttgcccgtgcttgacaatgactggagagtatggtattctaatcattgccgacagctgccggtgtggtggaattggtagacacaggggacttaaaatcccccggtagcgatactgtaccggttcgagtccggtcaccggcaccacagaacagaatatcgcggggtagagcagttggtagctcgtcgggctcataacccggaggtcgttggttcaagtccagcccccgcaaccacaaaaccgtctgatttcgcaagaaatcagacggtttttcttcactttttgtctccaaaagtttccggagaaattacgcgattttgcaaaatttgcagttgacccaaaccgtgacccagacagggcaaaaaacgtgccttggcgcagcccttctgcgccaaggctttcctgctgtttgggattattttttcgctttcagattgccgccgtcaggactttttccatagtcctggccgcctccttttgcgccgctgtcgtgacgtgggcgtaggtgtccagcgtgaagcctgcgctgaaatgtcccagcatcccggacaccgtcttaatgtccaccccattctgaagtgccagcatagcgaacgtgtgccggaggtcgtggaatcgaactctgggcaaccccgcccgcttcagcaccgggtggagtatatgcaggacgctgtctggtgagatgggcccgccagtgggcccggggaacacccagaggctactgcccgcttttttcttctgctgtttcagaacctggatcgtgtcctctgccaggggcagcgtccggtaggccttcttggttttcagggaggcatctacgatttttctgctgatccgggcgatctactgtttcatccaaaggtttccgtgttcgaaatcgatgccttcccatttcgggccaagcaattcgcctcttctcaatcttgctgccagctccacatagtacatctcgaatatcctactgtttctggcatctctaaggaaggatgccagctgttcaatgggcagcgttttcatctccttgcgtttcagcttcggcaaggcacagccctctgtggggtctgctgcaatcagccgttgctctttggccagcttcatggccgaggcgatgatctggcagatgttccgcaccgtcttggggctcaaaccctttgcctgatttttgctctcgaccctgtcaattctcccgctggtcagcagcttcttgcagaatttctgtaactccagagaagtgagcttttccagcgggaccttgccgatattcgacttaatgtggttgttgatgtacccccggtaggtctggtggggggacggtctcgctttgatctttgcgtaattttcgaaccactcgtccatccaggtacctaccgtgtacttccccgccttggtgacgtccaagctcttggtttcctcgatggccgctttcagcttgttcttcgcctctgcctgggtccggcccaagacgtttttgtagattagcttcctggtctccggattatgcccggcggtataccgcccttcccaccggccatcttttcctgatattaccttcaccgttggcccgtttctttgccatggcatccgcctccctttacgactcgataagcgtctcgcttcgctcggttgctcacatttatggagccagcgagctctcatcagcgaaacaaaatgccacagaaaaaagaaatagccagatggaaaggtgactgttatcaaaaagttaagaaagagcggccgacagcggctcttttctttgtatagcacatcaattttgacctggggatccttcattttcgccctctctgtggcccgcgtttcttcctcgtcctcaaggcaataccgttccatctccccggcgatccctatacctaactgaagcccggtgatgaagaatgtcaggaggtttcctcccgcagttcattctccagatccgccaactggagcaaggtctcctgatcttgttggcctaaccttgcgttgatttctctgtaggcttggtccagttccgcccggactttttgaagttctggctcctggcaggaccttgcgtgcaaggccttcaagtagtcgtacatcgtaccgcctccttgtcagcggaaaagcatgtcacgatgctggctcaatagccaggggacacggcgcctactatcagaaaagtaacaatttgtctgcctgattggaatccttgtcttgttttcagcgacgcattctttgaaggggctttcgtgcctcaatagccccggaacgccccagcggcactctgcggatctaaggagacagccgaattttgcggagaaaagcgtcattgctgctatttcatgtgtggaacaacgctctttcaaaatcccgcaactgcccgcactgcgggaagttgtgagcgaatcggcgcaacaaaagcgccggttctttctcctgctttttttcgtcccccggttcacttccagaaacatgggaatcctccaacggaagtggggccaatcgttgtgggcaaacctcatgtcatcttgccatttgatgagaaaggccaatgcaggcgtgaggtatctcgtcttttcgccacgctggcccgacaagggccgaaggcagttgtttgtgggcaacggatgccgccccggcctcgtccgcccgacacagcggcccacaggggcaaacgagggcggaattgttgggggctcaatgacagagaaaaaaggcttctttgtcgacggcgtcgtaattcgcgtatttagcaaaagcgcgttccctctccctatctttcgtcctctggccacaaaagtggggccgggcttctgcccagaactgcagccgccgtatagctggacgagatgcttgcccacaaaaaagcccggatggtcttgtacaaagaatcagcagagccgcacgagccgccccgctgattttacccagctccccacatgggtccaaaggtctgtgccatttacatagagttgcccgcattccaagcatcccgtggcccaactcatttcatattgcattttggaatttgaatacatagtatccacattgcattagcggatgtttattttgtcagatcctcattctttgccttctgctgaagaggttccatatttctgccgtagctgttcccaatggcgtaggaacgtagtgggcgggagtttcaggcgttccgcagccttacggatacttccgtaccgctcgtagaatgtctggagataccgcagctccatacgctccagcatctcattcagtcccgcctctgccggagcatcctgaacaggctccggacccgccacgttcatcggcaagctctccggctgaatcaagtctgtatccgtgatgatggttgcctgctcaatgctgtttttcagctggcggacgttcccttcccaccgatagttcagcaacgcaaagcaggttgctggggacagtttccgatgaaagtcgtatttttgattgtagtaatctagaaaatgctgagccagaggaatgatgtcattttttcgcttccggagcggcggaatatggatcggcatgacattcagccggtaatacaggtcctcccgaaagcgtttctgctgcaccatctcttccaagtcgcagttagtagcggcgatcactcggatgtccacctgtacgggttcgttgccgcccacgcggatgaaagagcggttctgcagcacatggagcagtttggcctgcatattcagagacagctcgccgacctcatccagaaacagcgttccgtgatctgctgcctctagaaggcctggcttcactttactgccagcgccggtgaaggcatggccttcatgtccaaagagttcgctctcaaagagagactctgtgatggcagcgcagttgatgggaacaaaccgccggttggaccgcccgctgttctggtggataaatctggcaatctcatccttacctacaccggtttctcccagcagaagggcggtagagtccaccttggctatccgggcggccagggccagcaccttcagcatctccttatcggccacaatcagtttgctttggccacccatccgggccttgatgctctccagttcctggagatattggtcattcagtccccggatcttatcaagctcctgctgcaaagagctgatttcgtccaaatcccggtcattacagatatagaattcaatctcaccgcagctatcaaataccggcgtgcaggacacatgtgcactgcgccctgtgcgatagaaggtctgcacaatggtgtgtggctttttggtctttgctacgatagcaccgcaggattcggaaatcagatggtttttcaccaactgctccaccggcacccccactaactcctctctccgaatcccggtgaggacctcataagcccggttgatccgcagcgtcaccagattccggtctgagatctggatggcatccgtagagttctcgataaaagcatccaggacacggttctgttcttccaaatccaaaactcgcttgcgcagttcctccatggtctcatgggaaaactgcgagcgcacctgcttttgctccaaaaatggaacacctcccttcgccttttgctcttttgtgcaatttcaaatttgaaatcacactttttatcgtcaaaactcatatcatctttgctttgtttttaacaaaaatgactatatcataaatcttatgttttcacaagttccaatttcggagcactctgctcaaaattcgttccaattttggaacacaaaattgcaatttttttcacataatcgaggccccgtttccgtcatggaaaataattcgatcttttttgaatttcaggaggaaccgcaattccatacagtcataggggtttctggcttttcgctggaatgtttttttaaattggcaagatttttgctataatgatttgtcgaattccaacggaatgtgttggtggcggaaatcccccgccagacataccatcgatgaaatatgtgagattttaaggaggtacaagagatggaagactggaaggtactctatgcttccaaattaatgacggcagatgaggccgtccggcagatccccgatggttcccgggtctttttcggccatgcggccaatgaaccccccgtcctggtggatgcgctggtgcgaaactatgagcaatataaggatgtggagatcgtccactgggttcccatgggaaaaggggagtactgcgatcccaagatgaaggggcaccttcgccacaatgccatgtttgtgggcggcccaacccgcaaggctgtgcaggaaggacgggcggactacacaccctttttcttccaccagtccacccgattcttctctgacggcaccttccccattgacgtggcgatggtttccgtcactccgccggacaagcacggctatgtgtccctgggcgtctccgtgggcggcaccaagcccgcctgcctgaacgccaaaatggtcattgcccaggtcaacgaccagatgccccgcaccatgggggagtccttccttcacgtctcccagctgacctgctgtgtggaggcatccacgcctctgccggagctgggcggaggcaccatcggcgaagtggaggaagccatcggccggaatgtggcctccctggtggaggacggctctacattgcagctgggcatcggcaccatccctgatgcggtgctgaagttcctgggggacaagaaggatttgggcatccactccgagatgttctccgacggcgtggtggatctgtaccagaagggggtcatcaccggtgccaacaagcggctggacaagggcaagatggtggctgccttcctgatgggctccaaaaagctttacgactttgtggatgacaatccggacgtgatgatgcggactgtggactacgtgaacaaccccgccgtgatctgccagaatcccaaagtggtgtccatcaactcctgcctacaggtggacttcaacggtcaggtgaactccgagtccatgggcaccaagcaattctccggcatcggcggtcagctggactatgtccgcggcgcggccatgtgtcccgacggcaaagccattctggccatgccctccacggccaagcacggggaagtgtcccggatcgtcccggtgtttgagcccggcaccactgtcaccaccacccgtacggacgtccactacatcgtgacggaatacggcgtcgccaacctgcgggccaagagcctgcgggagcgggcccggctcctcatcaacatcgcccaccccaagttccgggatcagctctgggaagcttactacgaacgctatggcaaggaggatcagtaatatgtccgagaaaaaaattgaggccgtcaatggacataccttacaaaaggtattcctgtccgtggaggatcacatcgccgttatgaccctccacaatcccccggtgaatgcggcagacggcgtggtgcaggaggagatcctgctcctgtgcgactatatcaaccatgaggatgacatctgggtgtgcattatgcactccgacatcaaaaccttctgcgtgggcgtggacatcaagcgattctatcagagcatcctggataaggatgtcaccaatacccaggaggtctattacgatggtgctcaggccctctatgaactgcgggttcccctgatctgtgcagttcacggccactgcctgggcggcggcgtgtgctaccccgccggtgcggatatctctatcgccgtgaaggggaccctcttcggcgcaccggaggcaaagctcagcgtggtgggcggcagcgcccatctagcccgcattctgccccccagatccagcgggatatgagctactgcggcaccttcatcaccgcagaagagctccacgacaagtacggcggtgtcaccatggtggtagacacgctggaggaactgatgcccgcggccatggacaaggcgcgggagttgtgccgccgtggtcccctggtgctgcggtacctgaaagcctgcatgaatgagcaggaggatttccagatccaccggaaggatgagctggaggtgacttacacccgctacatggctcgtcatgcggatttcaaggagggtgtttccgccttcctggaaaagcgggagccgcagtataccggccagtaaaacacatcccccatacaagactttaggaggaaggatcatgagaaagaatgcaaaaaaactgtttgcgctgattctggcactgtgtatgtcgctgacgttgctgactgcttgcggcggcgataccgctggcagcgattcaggcgtgggagagagctcctccggtggcgagacgatcacctggcgcctgcagagcagctactccctgaattccctgcagggcgatatggccaccaacctgaaggaggctctggagaccgctaccaatggccgccttcaggtggagctgtatgagccgggcgctttgtgccagacctccgatatactgacctatctctcgcaaaatgcctttgactgtgccgtcatcttcggctccaccttctccggcctgattccggaggcggatctggcctgcggcatcccctttgcatgggagagctccgccgaaatctatgacgtaatggagaactatgggttgctggatgtgatccaggaggcctacggagaactgaatctcaaatactactggaatgcccatgagcccaactacaacgtcctggcaaacttccaggtagagagcctggaggacttccacggcaaaaagatccgcgctctgggcgtgtggggcgacttcctggctgcgttgggggcctctcccaccaacatcgccggcacagaggtctatcaggccctgcagctgggcaccattgacggcgctctgtatggatggtcctctctgagtgactccaacaacatccgcgaggtggcgcagtacgccctcagcccctccatgtgcttctgccaaatggccaccgtggtgaatcaggacagcctgaacaagctccctgaggacctgcggagcatcgtggacgagaccatccggctggccaacatcggcgtcatcggccaggcccatgtggttggtacggagaaaagtgttcgagacgctatccagggcggctacactgagctgtctccgctgcctgatgacgtcctggccgagatgcgtgaaattgctgtcacccagacctgggaagagctggccgccaagagcgagcgtatggcccgcggtatcgagatcatcaagcagcaaaaccgtgactatggccgccaagtggattactgagtccgcgcgttcctcacagaaaaatagaattcaagagaagggaaagtgagacatgaacgcactattgaaattatcaggcggcattgacgccattaatcggaccattggcagaatcttcgcctggattcttctgcccatgatctgcctcaccgcctttgaggtattctcacgttatgtcctcaagtctccaaccgtctgggcatgggagctgattatccagatctggggcctgatgctgatggcctgcggcggatactgctactggaagggcggcctggtgcgagtggatctgctttataataaattccctgtcaaagtccgctgcggtatcaatatcgccaccgccattctggtcctaatctgtatggggctggtatttatctacggaataaacatcttcctactgtccttccgcctcaatgaacggatctcttccgtgtgggggtctcccatgtggaccatccggttttgggtgcctctgggcgctgcactgatgttcattcaagccatcagtgagcttatcaagaatgtagccgctatggcaggcaagattgaactcaccaacaactccgacgaagtcgcggaggcaattgaaatcgtgaagtccgctgagcatctgcctgacgaaaccggaaaggaggacatacagtgagtcctgatattatcattttgctgctggggctggtagccctgatggcgctgggcatccccatctgctttgccatgatgagcgtggcttcagtcatcctgctggtgttctacggctctggcctgctgaatgtgttgaacgcagcatttgtctatcagatgcagtcggagtccctgctggccatccccatgttcgctctgatggcggcgttcctccagacctccggcatcggcggagacatctacgaattcttccacaagtggcttggcggtatcaatggcggtctggctatggccacagtggccaccacggcagtcatcgccgctatgagcggtgtggcggccaccgctaccatcatgatggggctgattgcactgccagctatgttggaccgtggttatgataaagcgttggccactggccccgtgctggcaggtggctgcctgggccccattatcccgccctctaccatcatgatcatcatgtcttcctataccggcgtgtccgcaggctggctgtttgccggcggtgcgttgcccggcgtaggcttggccctgctgttcatcatctatatcggcatccgctgtgccatcaatcccaagctgggccccggcatccccaaggccgagcgtccctcctggggcgagaagatgcgggtgtttaaaaaggtcatcgcccccattgccatcatcgttctggtgctgggctgcatctatgccggaatcgcaacacctactgaggccgccggtgtgggcgctttcgcctccatggtgtatgccctgattacccggaaactgaatgtgaagaatctgcgggcctctctcatccagaccatggaggtctccgccatgcttatgtggattctcatgggaggcgccgcttacaactccctggtgaatatcacccgcctgtctgacgtggtagccgctgcttttgcaagctccaatctggacggcctgcccctgatgctgctgatctttgcgctgttctttgtgatggggatgttcctggacactacgcctatcatcatgattgccattcccattctgctgccggtaatccaggcttcttccctggacaccaacgccaccatcctgattctgtgtgtcactctttgcctgggcatgattactccgccttttggcatcaatatgttctacttgcagggtgtggcacctccgggagtggacaccaaggttatgtacaaggcggtcatgccgtatgttattattttcctggttgcttgcttctttatgatgctcttcccggaactgattgtcatcttcccgaacgctgcgatgggatattgatctggaagaacatcggagctgcaaagacccagggcccgttccgtttgattcatgcaatgtggtgttaacacatctcccccaatatgtaagcataaaccgttagatgcatttcttgtgctccttatttcggcatctttccccgccccatgacttgccacagattgctgaaaaccgtcatggagtaggaagaaatgaattccgggttttggacgattccaggtcccacaaaagtccggaaaacgttgcggtgcagcggatagagaaaacgatagcagtttataacccggaggtcgtaggttcaagtcatgccccgcaatcacaaaaccgtctgatttctatgaaatcagacggtttttctgcctttgcatccaaaggtttccggagaaataacgcgattttacaaaatttgcagttgccccaaaccatgacccatacagggcaaaaaacgtgccttggcgcaactctgccgtgccaaggctttcctgctgtttggaaccatttttccactttcagattgccgccgtcaggaccttctccatggtcctagccgcctccttctgggccgctgtggtgacgggggcataggtatgcagggtgaaccccacgctgaagtgccccagcatcccggatatcgtcttgatatctaccccgttctggagggccagcggtgcgaatgtatgccgtaaatcgtggaacctgacccgaggcagacccgcccgtctcagcacccggtggagtatatgcaggacgctgtccggtgagatagaccgccggtgggtgagggaaacacccagggactgctgacgtttttttcctctgctgtttcagaacctgaatggtatcctccgccggcggcagcgtttggttggcgtttttcgtcttgagcgatgccgccacctctccgttgatgcgagcaccatgccgtttcacccaaaggccgccccggtccaaatcaatttcctcccatttgaggccaagcaattcgccttttctcaatcttgccgccagctccgcatagtacatctcgaagacgccgctctccttggcttcctgcagaaaggaggtcaactgctcgacgggcaatgttttcatctcccgatgttccagcttcggtagggcgcagccctcggtgggatcggtggcaataatttttttctccttggccggcttcatggctgaggcgatgacctggcagatgttccgcaccgtcttgggactcagacccctgggctgccgcttgctctcgactctgtcgattcttccactgttgagtaattttttgcagaccttctgtaattccagagaagtgagtttttccagcggaacttcgccgatatccggcttgatgtggttgtcgatatacccttggtaggcatgatgggaggatgatctcactttgatctttgcatagtttttgaaccacttatccatccaagcacctactatgtactttcccatcatggtcacgtccaggcccttgatttcttcaatggccgctttcgggtttgcctctccctgggtccggcccaggacgttcttgtagatcggctttccggcctccagatcgtgcccggctgtgtagcgaccctcccagcagccaccttttctttttctgatgttgcgctctccgtcggcccatttcttcgccatggcattcattttctttgcaataacacaacatgccgcagagaagagaaaaacgtcaatgccgctatttcatacccagaacaacgccctttcaaaacccgcaactgcccgcagtgtgggcagttgtgaccgccctggtgtcgaaaaggcgtcggggctttcttctgtctgccgggtgacggcgctctctttgtcaacggtgttgtaatcccggcattgagtaaaagcgcttttctgatttctccccttcggccaacaggttgccccaagtggggctgggcttctgcccggaactgcggccggcgtatagccgggtgcgattcttgccccactctggtgggcacaatttcactttccattttatctcgtggttttttaaaagattctgaaattgcggaaggggacggctctatctggccgcccccttcatcatttagttcagtgaaacaacgttttagttgttaaaatgcggtcaaattctggcatgtagcttcaaactgatgcaacctagacaacagttcacttcgcctttcttctgtgcagaaggcggcgtctactgcataatactgcagctttaatagctcctcaattttccagtgatactgttctgccacgcgttggagctcttgacttagggaaacacgcagaagctgcggatcatccgtgttgactgttaccgatatccctctactatacaattcacccaacggatgattgccaggcgtatagaggccgcctgccacattcgacgtatagcagatattcaaaggaatccgctctctcaggagccgttccagcagtttcaagtcctccactgcccgcacgccatgatcgattcttttagctcccaacagttcaagagcttcctgaactccttccggcccagaggactcgccggcatggacggcaatgcccagcccggcctccgccgctctcgccagtaatggcgcaaatctctggttggagtcctgcgagcaggcctcgtttccgtcgacggaaaccccgaccaaccgcggatgtctgtgggacaagatccactctatggtcctgcgggcagacgctgtatcctgttctctgcgcagggacacaagaagccggcaatccggcagtccatctgctccggcctggtcaaaaccttccagaacgcctgtcaacagctctccggtccgaatgtttttccaatggctgggattgacgatgatttccgtatagaggataccctgctcctgggcgtactttgcatggcggtatgcaatctgctgagcagtctcccgattctgcaccaaactgcagatccagtccagcaggtcaaggaagtccgagagacctgagaaatcgaacaggtgctgacggggacgtggcagggaaatcccctgcatttcggccagcaggcagacggtttcaggatcgaatgtgccctctaggtggatgtgcagctccagcttcggcattcgctggatttgttccaacgtcgccataccggtcattgagcaccttcctgctggaagcgttctacccaggcatcaaactgtggcaggagatgctgtccgctgatggagtaggcaaatccgttgcggatgatctggatcagctctgcttccgtcaatcccatcttctctgcatccagaatcaattcctctgtcatagagcaggtataaggcgggtcatcagaactgatggagaccggcacgccggagtgcagcagggtgaggagtgggtgtgcctcaaaactggcggcagctccagagtaaacatttccggaaggacacatggcacagagaatctgatgttcctgcagatattccatgagttccggatgttccgccgcccgacagccgtgatcgattcgctgaacatcgagcttcagcagggcatcccagatgttgtccgcaccgccgtcctctccggcatgagcggtaaggaacagccccatttcctttgcctcccgatagctctccaaatgcttgatacagggatgaccgttttcctcacagtccattcccagccccgcgaccatatccagatagggacggagcgccttgacaaaagacaggcaccgctcgctggaaagggtccggtccagtccggcgatgtagacaatctccacgccataaagctttttcgcttttttttgtgcgctgcgatacccctccatgaccacttttaggggaattccccgctcttcgttcagtggataatccaaatgcagctcttggtagataatattttgacgctgatcctcttttgccaatgccaggacaactgcttcatagtcttcctcatggagacaaacggagttcaatgtccggtcacagatcataaacccatccagtccctttctggagattagatcctgagaccagaccgcaatttcttccgtggagtggactggcagcttcacatgatttttctccgccagctccagcgcgagagcccaggggatggagccttcaatgtgaatatggttttctgccttcgggatttcctgcaacatctgcttttgccgagaagttaacatagaacaaccctccattccgtcaaaaaatagcgtccagaatcaagtacatcaaaaagactgccgttaggatcagcatcgtgggagagagctgctttcttctgccggtcactgccatgcagagagtgtagctgagcatggaaaaaagtacaccataggcgatattgtacgtaaagggcatggctgcgacggcaaagaaggccggcatagccacggaaaaatccgaaagatccaaagtggagagtggctccatcatgaaaatcccgaccatgatgagcgcaggcgctgctgcaatgctgggaatcatcagaaaaacgggggagaagaacaacgtcagcagaaagagcaggcctgtactacaggcagtcaggccggtccgcccgccagcggcgatccctgcggcactttctgcgccgtaaatcgtgaccgtactggttcccagaaccgcgccgactgcagcggctcctgccgagacgaacagagcttttcctgctcccggagtcttgccatcctcatccaccagtccggccttggggcgatccccaagaacacacccaaactgtcaaatagatctacaaataaaaagctgacaatcgcaaaaatggttccaagaacgaaggggagcggtccggaaaacatccccctgtaactcaactggcccagagtaggggccagagcctctgctggattgtcaaaggagaaaacagaggtcggcagagtggtataggccgcaccagtgacggggtctttcacaaacagacccagaaccgtcaccagaagaatgccaatcagaatcccacccttgacctgtcggatgaccaataccgccgtaatagcgatgccggccagcgccagcactgtgccgggattgctcaagtcgcccaccgtcaccagggtgctatcagacttttgaatcaggccagcggactggaagccgcaaaacgcaataaacataccgacgcccgcgccaatggcctttttcacgcagtctggaactgcgtctacaatatgctgctgcgtcttaaatgcactcaaaagcataaagacacagccggatgtaaatacgcacgccaagccgttctgccaggaaaggcccatgccctgtaccacggtgtaggccatataactatttaggcccatggctggccccagagcaaacgggaagtttccccacaggccgatccagaggcaaccgatgcatgatgaaagcgccgttgcccagaacaccgccttttggtccatgcctgctgctgcgagaatcgttggattcaataccataatgctgacacaggagagaaaagtggtagctcccgcaatcaattctgtccgcagggttgttccccgttcagacaaatgaaaaactctctcaaaaattgatctgttcccaatcgtagaattcatgatttcccccttcctgtcatgccgcctgatttgatggcgtccctgtgcgcacaggtgttagtgccatcttagaataggaaaaaacagatttcaactgtctgtcaacaagtcagacgacatttttcataccacccttgtaagcgtggaaattcgggaagattccaaggagttgtccgaccaatttgaggacctttcttgctttcttttcataagttgtatacaataaaggagcggatcccatacatctgaaaagaaggggattgtctctatgaatacacacgaagtcccgctgcgggaacgtgtccgggcccagcttctggagctcatttccgaaatggatctgaccgtcaacaccagattgctctctgaaggacagctggcagcgaaatttcaggtgagccgcagcaccatccgtacagtcctcagtgacttggaagtggaaggcaaggtcatccgccggcaggggagcggtacctatgtcaattcacaggccatccaggtgaatacaacgctgtatcctcggatcgacttgcgggaaattgttgctagaaacggctattccgccaggagtgaggtgctgtctgtccgtcagattccagcgggaaggcagtcccttttgttcaactgtggcccgacacatcagctgcaggagatccgcagcctgtattacgcggatgagtttccatgcatgtactgcattgattgtatccgagacgggcggatcacggaagatcagtggcggactccggagcttgcgacacagtccatctatgagtttctcaaggaggcgggcaatattcatgtaaaatgggatatgatgcgcctccgggctactaccagcggtgaggttccagagctggcggtttattttgaggtccctgtgggaaagatccggccctttattcttttagagattacgaattacgatgacaaaaataacccggtcctctgtggaaacatctatgtggatacggagcgaatcaaattgaatcttgtacgtgatttggggcagctttcataaggattgttcctacagatcttttattgacagtctaatgaaagatggtttccgttttcaggttccctgctttctcgtgatttagaacctgaccccaattgctgaaaatcgctgcggaacggaaagcagctcataacccggagctcatggaacctaactctggcagtcccgcccgcttcagcaccgggcagagcatgtgcaggacgctgtccggggagatggggcctccgcgaccttgtcatcgattcgggcgacctgctgttttagccggagtttgcctttttccgagtcaatattctcccctttgaggtcaaggagcgatcctgtcgaaggccggtgggcaactctccatagtacatcgcagacacgccgatgccgtttgcctctctcaggaaggccatcagttgttctgccggaagtgtgatcggtggcgatgaactggtggatgctccgcactgtcttggggcttaggtccttagcctgcttttgctctcgaccctatgaattctcctcctgctgatcagcagtttcctgcagaactcctgcaactccagaaaagtgagcttttccagtggaatctttccaatgttgggcttaatgtggctctgcgctttaccatggtgttcactgttttcgcagcaacacaacatactacggaaaacagaaatattcagggactacggtcactgttggcttaaggttaaaaaagggctgccagcggcagccctttttctttgtgtagcgtatcaatttttgacccggggataccctttttcgctgtttctatagctggcttttcttcttcgccattggatgcgatgtctggcatgcatgagggggatgtactaggccggagggcactccgctccctcgatccctgcttttatcgcttactggctcaccataatacgacaagcatggggggaaggctcctaagatcatctcttctaccatgcagtcccattaggactccgccagtcaaagttccaaagaaattgccgctaaacacaagctatgcagtatctatacaccaataagaggtaattttcatatcttggcagttttggggcagtgttgttgttctcgaagatagttgtcgggtgactgcctgctgtctaatctcccatgcgcggttgccgtcttagtcctccatcccattaggccggatcaccaacttgagcacattatggtccaacacatcttcgatggcctgcgggaattcttccagtggatagagccgggttatcagtcggtccgttttcacctttccggtatccatagcatccacggcacggccgaattgatgaacctggcagtaggacgtgtagtactgcaattcattgcgataaaaatatgcggggttgatggagatgtcctcatcatcctttgtggaactgaattgaagcagccgaccgccctttttcaaaagctggaaacaatccggcaggacagaggcgcttcctgtggcatccacgatggcatccacgccgtaggggaaccggtcaaacactgctttggtgtggactgcgggatcgctgcggtccatcagaatggtgtcaacgccataagcgttcagaacatccaatttggactgagtgggagccaggcagatcacatggtttgcgttggagtgtttgagcagctgtgccagaatgatgccgttcggaccggctccgaaaaccagcacatcctccccgtatttgacgtcaaggcgatccatggcgtgaatgcagcaggcaacaggttctgtcatacaagcctcgttgaaggagaggtggtccggaatccggaacacggtcttgtcctttacttttaagtactgggcaaatccgccggggatactgtgccccacagactggaagttcaggcagtgggcgtacatctcctgctggcagaagtagcactttccacaggggacagcattatcggctgttacacggtcgcccacgttccagcctgtcacagcggagcccacctggtagatatagccggcgaactcatgaccggtggtgatgggatagcgtcccaacttgtgaccggttgtatgatgacggcggtctgcgcctttgcagatgctggctgccatgaccttgatgacaacctcatcctcgccgcacacaggcatcggtacatcccggacactgcacacggacgggcggtcgtagaccagcgctctcatggtttccatagactttcctcctttaagcgatttgaatgggtgcttccactccttgaaacagacgaatcttggctgctgccacgtcgtgtacacactgagcggcggcgcggtacatggcatagatattgcgttgccccactgcagactccagtccgcacataaaggcatttcggatttcagttgccacgttgattttccgaatgcccagtgcaatggaccgacgaatcatatcgtccgggataccggaaccgccgtgcaggaccagcggagggggatttaacgcctgacactgctgaaggcgatcaaagtccaaccgtggaagtccctggtacattccgtgggcattgccgatgccaatagccagcgcatctacatccacctgctggataaagcgggcaacctcgtccacatctaccaaattgtcgcgggaatggctgatgccatcctccacgccgtaaattgcgcccaattcagcctccacagagacgcccactgcgtgggctgcctttaccacttcctgggtaatacgcacattctcttcaaagggcagatgggacccgtcaaacataacagaggtaaagcctgcccgcaggcattggattgtttgctcgtagctggctccatggtccagatgcatgacaaccgggaccgtggactcgtcggccagccggcggactacatccgccagatggtgcatctgtccagcctggatggccccctgaccgatggtcagaatcacggggcagtgatactcttctgctgcagtgataatggcttccggtatttcaatattgtcaatattgaacccagggatggcggttttagactgggtggcaatgccgagaacctcttttaatgttgccaatggcatatggctcgcttcctttcttgggtgtcatgagatatctgagcgaaaatccagcggctggtgggaatgaataaaatcattcactgtcgcccgactgcccatgcctgccgttgcaccaaccgcctggattgccaaagcggaacaggcgcttccaagagttatacagtcctctgggggcaggttctctcctacgccggtcaaaaagccggcgcagaaggcgtctcccgcccctgtggtttccactatggaaaggccctggtagatgcccgcaaaaaaggcggtttgacgatttttgaaataggaacctcggctgcctagttttacagccacgtttttgacgccgcggtccaggaagaaatctgcaatagcccgaggatcctcggtcccggcaatctgggaagcctgctcgatgcttggcagaaaatagtccagatagggccagcaggggtctagaattcctttccaccggccgctgcggtcactggtgacgtccatagatgttattacgccgcgctcctttgcggctttcagcaattgggcggagccctcgccgtcaaacttcggcagatgaaaagcgcccccaatctgaagcatttctgcccagtccagcagagacagatcacagtcgtcaaagcagaactctgcgctggtgcccggatcctgcaggaatgtacggtcacctttgggattgaccaggatgacagattttgtttgccgagccgtggaggaacggacggtatgggatatgtcgattccggcagcttgggccagagaagccacatagtctcccatctcgtcacatccaagccgccctaagtaggcgacttggtggcccaacttggcaaaattaattgcgttattgttggcgtcaccgccgctggtaatgcggatgtctggcactatctgggtatcgttttcaaaggggatctgttggactggacggacaaaaatgtctaccagcatttcaccggcgcagatgactctcatggaaggcgcctccttaaaaggcgtgcatagcctcaaggcaggcatccatagtggtcagagggctgagttcaaaggcgaaaataccgtcgaaaccaagttcgtccaccagcacatgcttgaggtaagggtagttgatctcgccggtgccgggttcatggcggccggggacatctccaatgtggatatagccgatgatgtccgcgttccgccggagggtgttgaccaaatcgccctccatcagctgcatatgatagatgtcatacagcagctttacattgggagaccctacgacccgaatgatatccgcagcagagtctgaagtagtcatgtagtaaccgggcttggcataggtgctcacaggctctacttgaagatagagaccctccgcttctgcgattttggagatctccagcaagttcttggtggcacaggcaattttggtgcggtcgttcaaatcgttgccgtcggtacacattctgccttcctcgcccaaggcgttggaatggatcaccagatttttacagtccaaaaaatgggccgcttctacagatcgcttgaagtattctaaaaattccttgcaatgggcgggatcaatcaggttgtagtccttgtctccagagaaacaccccagctgaagccggttttcttccagtagggatttgatcttcttgatatcatgctgtgcccaggaaccgaattccacatagtcgaaaccggtttttcggaccatggggaaccggtcgtagaagggcagatctacaaagagcttctcgatacagattgattttttcatatgacctccacgtttaattgccagactgcttgttggtagaacgttttttccagagattcaggaaaatgggagagagcagggagatggctgcaatagccagcagtactagggcgatgggatgagagaggaaaatggagaagctcccgtccgagagcaccagagtgcggcgcaggttctcctccaccgtgccgcccagaatcaggcccagaataatgggcggcatgcagaagtccaacttgataaggaagtagcccacaatgcccgcaccgatcatcagaaacacatcgtagatattgttattgatggcataagtgccgaccacacagaagacaaacacaatggggttcagccacttcataggtaccaggctgattttggagaagatgcggatagcaccatagcccaacaagcacatgaagacgttggccataaacagagagataatgatggagtagacatccaccgtctgggtgctgaaaagcagcggtccaggtgtaatgccctgcatcatcagggcacccagcatgatggctgtgacggagtcaccagggatgcccagggtcagcaatgggatcatggcgccgccggagacagcattgttggcggcctcgggagcggcgatgccttcgggagcaccatggccgaactcctccggatgcttggaccagcgtttggactcgttatagccgatccaggaggcgatatcgccgccggttccgggaatggcgccgataatggtgccgataatggagcacatcaggatcgtaggacttgtccgcttaatatctgatttagagggcaaaatctggtccagcttcttgcgcttttcccgtttgtactccttcatagattcctccgctgtaacaaggcactgggagaaggcgaacaggccgatcagcagcgccacgaactggacacctccgattaggtaggtggttccaaatgtgaaccgcatagtggcagaggttgcatcaatgcccaccgtgccaagcagcaggcccagtatagcgccgatcagacccttaatgatggagtgagaggacacggcggtgacgatgctcaacccaaacacacccagagcaaacatctccggtacgccgaagttcagcgcgatcttggacagcagcggagcggtgaagagcagtgcgcaggcagagaacaggccgccgaaggtggaggccatagtggaaatactgagggcacggccgggctgccccagtttggtggccatgggataaccatccaggcaggtggcggccgagttggcagtaccaggcgtattgatgaggatggcggtgatggagcctccatagatggcgccgcagaaagtgcccagcagcatcataatgcctgcttgatcaagggaaaaagtaaacgggagtagaatggagaccgccataacggcagataggccgggcatcgccccgcacaggataccgaaaaacacgcccaaaaacatgtaaattaggctggtaggcgtaaataccaacgctgcagcttgcagaaaagcatccatagaatcgctccctccttatcaagagaacaacgtgcccataggcagcgggacccgcagggccacatcaaagctcagccacacgaatacacagatcacgacggtcagtcccgccaggagtttgacattacgctcaccatggataaacatacatactggcaacataaataggatgccgatataaattcccaggaaataaataattgcaccagtggctatcagtgtcagcgataccagcaccatccgtttgaatcccacagtcttaaatgcaaatggagaactgcgggtttcttttttgctgaaaagcccctggagaattagcacgatggacagagatcccataacgaccgacaggcacttcggccagaagctgggacccagtgaatctgtcatcagcatgctggtcattcccagggattccacataggcgaagatcgacagggccagaaagatgatccctgtgactacgtttgcttttttcaacggtatccctcccgcaagaatgttgcaggcgcacggaacaggacctgttccgtgcgccctgattacgtgactacgcgatatggaaatgattcttcttcactcagccagcaggccgacgtaatagttgtacgcctcttcgcagtactgggtcataccctcaatgtcccataccttgggcgtcatcatctgggattccgtcagttccgcataggtttcggaggccacgccctcattcagcgtgttatgcagccactcaatgatggcgggatcggcatcggaccggattcccaggaagcacacagaccgcagatccatatcgccgcactcctcgggataggtctgggcgagagagggggttccaggtagagagtcggactcctcggcagaagtaacggccagaagcttcagggtgccggcttcaatctgcccggccacgccgctgacgttgatgaaggtcgcatcgcactcgccggttaccacagccagagcgcagtcgttggaagagtcataagttacagtccgaatctgacagccgaaggcgttggacagtgcaatggttgccagaccgccgggagatcccagaccggtgatcgccacggtaacggcgttgtcgccgctggagagtttgttaatgaagccctccagtgtgctgcaatccccatcggcggggccgatcaggcagtagggctcatcttgcaggcaaacaatgggagtaaaatcctcctggaggacaatgtccgtggcaccgatggcacggttgataatcaggtcaccgttgacccccacgatggtgtagccgtccgcagcccgggtcagcccctgctcggtgcccaccagaccgccgcctcccgccacgttctccaccacaaagttcacattgctgggcagcgcgtcctcggaaaggctttgaaacagggcgcgggagagttggtccatcgtaccgccggcaccataggggatgatgcaggaaatattggtggtgggataatccggtgcggcggtgtcctctccggaggagtcctggcccgaagactgttcgccggtgccgccgcaggcggtgagactgaggcacatcaatatcgcgagaagcaaagcgattccttttttcatgttaattctcctttgttccgtatttatgtatcccctgccggatcaatgggcggggaatcacaacttgatgacggccttgaccacatcctgacgctgataaagcgcggcgtcaaaggcctcctgcacattttgaaaatcaaattgatgcgaagcgatggcttttacgtcaattcgaccggtggataccgcccggatagctgtgggaaaattgttgtgatagcggtaaatggtccgaatttcaccctccttatacatcaaatccataaagcggtaaggagtttcgccattgatattgccgacaaagacgatgacgccgccccgccgaaccagatctgaggtttccgccgctgtgtgggagttgccggcggtttcaaataccacatctgcgccgcggccctctgtcaattccgtgacccgtgccatggtatcctctgtgctggcatcgataactgcatcggctccaagttccagggctttatctaatcgtttggagaagaggtcggaaacgattactctgccggccccccgggctttgcaggccatcatggtgagaaggccgatgcacccggcacccagaatgaccacatcctgccccaatgtcacatcaccccggctggcagccgacagccctacggccagcggctcgatcaaggccccctccagggaggagacattatccggcagtttgaaggccagatgcgccggtatggcagcgtagtcccgcagcattccatcatagggcggaactgaggggaagcggacatctttgcagagattatagcgtccggacctgcactccgggcaaaccccgcaagtaatctggggctcaaagcagacccggtctccaacggcgacattttgaacacccgcacccacctgtgtgaccgtgccggcgcactcgtggcctagaataaagggcaggtcaaaagcctttcccttccgcatgccggattcaaagaaatgcgcgtcagatccacagacgcccacatactcgattttcagtacaacttcgcccggctgcgcttgcggcattggaagctcccgaatttccatcttcccaggtgtgaccatgtaggcggcccgattccgtatctccatgaaatcctcgctccttttccccaaatacttactcactaattctgagttgccaaattttgtaggtattttatggtaaatttatgagtatcttttagataattatagcaaatattgtggggttttcaatatctaaatgtgataaattcttgacgaaactttggccattttgaataataagagttttatttacagcaaatacctgtgcaaaaaaattcttattttcatcatttcttgattattttgggaaaaatgattgcataatggcaaaaatatgatataatttacccaaattataccgaataatttgctaatattataggaggaatccttatgcgggccgagcgccttaatgcgatggaacaatatattttggggaaggaaaccgtttccctggaggaattgtctacgcaattttctgtatctatgaacacgatccggcgggatgtcatggaacttttgagccgtggaaatatccgaaaagtctatggaggcgtctcttccaccctgatcaaccggccggtgggcttttctgtccgggcccagaaaaacagccgggccaagcagattatcggacggctggcctcccaactggtcagcgatggggcgtcaatttttctggactccggttccacaacgccctatatccttcagcatatcggcgagaaaaacggcgttaccgtgattacccacagcttgactgcgctgtatgcggcctcgtctttgtccaacctgaacattattgcgctgggcggtatttacgcccccgccacgtcgtcctttaccggtatttccacactggatgccctctctcgcctgagcattcagacaatctttatctctgctaccggcgtttcaattgaaaacggccttaccaacagtacttatctggaagccgagatcaagcgcagcgtggtacagcgaggcaatcgggttgtcctgatggcggaccaaagtaaatttggacattccgctgtgatcagcttctgcccatttgagcaactgtatgccatcgttacagactgcttgccctctgagccgtatctggaggcaattgatcgctatggcatccggctgatttgccctggtcacgaaagtgattgagtgcaatgcctggggggagttcaacggaaaatccgtgttctgaatccaaaaacagcgttttgatttacttttcctcaattttttcgcatcatccccttgtcttaatactactgggcttattgttaggccttgttcaaacgagatggcagcattcattttgcattcgctatttctacaggaaagatcgacaagtagcgtctagacacatccaataccctgtcctatacggggcaaaaacgatgcccggacgcggcgtctccgcatccgggccgtgccgacttttcggagggcatttgctgggactttccccatagctttcgccgcccccttctgggccgccttggtgatgtgggcgtaggtgtccggagtggagccggccgagaagtggaccggcatctctttcagggacttcaccaagtacatggcggtcaccagcgacagcgggtacaccatcaagaaggggagtaaaatcacagtcaaaggaatccgctgagaaacgagacaagccccgggccttttggcccggggcttgtcattaagctgttttcaacgcagcaaagagactcaattgagggtaatcgtgtaagttgcgtccgctgcgccatccaggtgcagaacaaccgtcatgctatcggtgacagcggtagtatccttctcgccataaatcgcgccgaaggggctcacaacctcgaagtagtcggcagcatttccaccatcgacctcgagagcagcgtacaagtcagcaaccgtagcgttagcggaagattcgatagtgattatcttggagctaatgctcataacggaagaagaaatactatccttaaccttcagcgtgccagagcttgcagctgcaacctcaacctcaacagtcactgtcgtggtcttggaaccatcggaagaagtgaccttgatggtataggtgccctcacccagagcggtggtctgggcctgggtatccgcatccacatcggtagagccgttcttagtcaccacaacctttgcaccagcatcgttcggcttgataacgaacttgggctgatcgttctgcgtagcaggcagattgatggtgttggtctcaccatcaccgagcttggcaacagtctcgcccttcacagtaatgctagcaatactggcatcattgctgagctcagcggcttcagtagcctgggtcacggtcacatacagctcttccagaaccttgccgttatcagaggtcttgccggcatagtcataggtgtaggcatagcccttcagcgcatccaccagctccttggcggagatattggcggccacctcatagtcggcatcctcatccttgttcatgatgctggcgtctctgtcatcgcccaggtcaccaacggtcaccaaggtgatagcggtgtcctcggtcaccagatagcggctgccattaatggtcagggtgccggcgctctggctgatcgcgctggtcttgtcagtgtcagcaatcacgctgccgcctgcggtggccgcctggaagtcggtcagctgaccgtcggaattacgggtcagatagtgggcaacgccatagtagtcattgtcggaagtgatcttgttgtcagcaacaatgtcctcttcctcatcaccgttcagaacagtgtactgatgatagacctcgttgtcggtggtgacatagcggccatcataggacagaacatagaccagagtggtctcctgctcaccggagatggtggcatcgccgtcaatatcaatatagatcagagcagcatagccattgtcacgcaccagagcagagacagcagcctcactggaggaatccgtcagctcaatggcggggaagttcttcacgccggtgtagacatacagatcatcgttcttgtcgctgacaatgacgatggtctcgtcgttggccagagaaagatccgccttggtagtgctgttggaatcgttctcgaagggagcgaccttgctgttttcggaaacagtccccttaccgctgtagctggcaatctcctcgtcatacttggactcaacagcatacagagtgtattcgtcagcagagttcttgctgtaggtgaaccagccgatctgatcggcgtcggttccccaacgagcaatggtggacttgctgctcacctgctcaccggccttcttatcataggccttgtccacgacgatctcgtcggtggtaccatcggggaagatggcgttggccagagcgcgggaggtagaggtcatgccgctgctgctgccgaattcagcgatgtacacataatcgctcaggacaacagactcatccactgcgatgacatagccataggaatccagcaccagggaagcctcgcggcccacattgtagctggttttcttgatgttgtcggcggtggcggagtactcgtacttggtgccgcccatggtcacattgctgccgtccttatagccctcaacagtgccgttgacaacctcagccttgtcaatgctcttgacctcgtaacggctgttgttgttgacggcggtcaccaggacatagtcgtcggccttcaggtcggtgatattggcgaaatcgtccacatccagggtccggctgtccaaggtgatgtcggtgtcatacttgctggagtcagtggtcaggctgaccgtctccttgcgggtgtcatagtcggaagcggcctggaagacataggtgcggacggtgacgatggtgacatcattggtgtcgtcgtccacatagatctcggtcaggtcgccgttggcagtgttgttgaccgcgccggtgttgttgcgctcaacatagtcctccacgtcagcggtcttaacgggcgtttccacaccgtcgaaccacacggtcaggtcggacttgccatccgtcagatcgttgtagactgtgcggcccacagcttcatacacatcagacttggagaccttggcggtgtaggtgcccaccagctggtccatattggcgtaagtgccgatctcgtcggacttcagagtccagatgttggaaggacggccgaagtcatccgcttcgccgggtgccttctgcagatcgtcaaagtaccgctcggcgaactgcatcttctcgtctttctcaatagtgttgtccttctcgatggggttctctacttctttacgagtagaggtggaggtgatctccacgccgcccacaacgatggtatccttcttgtcatactcgaccatggtggcctgcagcatattgaaggcgtacagggcggcctcctgacgggtcacagcctgggagcccacgaactcgtcgttgccgtcgtccagaccgatgccgctggcctgcttgatgacgctgacctgccagttggggccggtgtagccctcgatggaactgtcatagcccagggcgcccagcagcatcttcatgaacgcgttgccgctcagggtaccggtgggacggaaggtgccgtcagcatagccgctgatgataccctgctgagagcagtaggtgatgtagcccgcgaaggtgttggtcacgggaacatccttgaagggggcggtgctggccgccagagcagatgcagtggtggggcccaggatcaggttgcagatgatcttggcggccgcgccacgggtcaggacatcatcgggacggaagtcgccgtcggaataaccgtcgacaacacccagggcagagatcacatccacagcttctttgtaggtgatctcgctgccgtccgtgaagtccttggcgcccgcgctgacagtgaccagagacatggtcatcaccagagcaagcaccagtgaaagaaatttcttcattcggatttctcctcctttaaaagatttgcagagagcttttgaggtccaatctccggaccggcttcatatgcgcaggggtgtctcttcccgttgctccggcccagagcggaccacagaagttcctttctgcgcgttcactttaccccaggagaatgctgctgtctacgatttgccgggttttgttaaaaaagtgaaataattactggatttcttgcgcttgccatgaaaagcaagtgtaaccgatgaaaaagttcccaaacaaaggggcgattccggcaggtctcctcataggggcaaaaagaaagatgccgtgaaaacagattctctgctgccacggcatctttcttctgctatgtgggatgcattgcccaacaggctacgattctttcagatagtatttctggccgactttaatcaggtttccagaatctacttcatgcttgagcagcgcggagcattgctcggtttcaatctgcagggcggtggtgatgtccttccgacaggcaaagccctccttcttcagatattcgtagagggcttcctgctgtcgttccggcggaactacggaatccggtaagtagtatttatagcccacgcggaccaggagacccttatccagcatggcacgcagccgctgatacgcagcggatttggtctggccatataattccatgatctggctgcgtgtgatagggccactgcggcgaatcgcctctgtgatcttttgttcccaattgctcttttcgtatctggtccagagatctcgcaacgtccagttctccatgccgccgcggatcagggcggttcttgtgatcctagacacccgcgaaacgtccatgggtttttttgactcggcggagagcaggacatggagatcctccgtccgcttctggagccgctttgccaatattcttttggctgccgctgtcagcggtacctctccttccggcaggtgaatcagattcttctccagatccacctgatcccaagtcaaggacacaatgtttttagcggtcagccccatgctccaagtaagccagagtaccaagccggcaggagtgtctttttccgcctgcaaaatcttccacagcttgaactcatcgatgtccccggacttctcactatgcttggggccagctcttccgttcggcagatactgggcaaaatgcaattgtaaagaccggatctccataccggtgatacgagccacataggaccagtcgtgttgttccagttgtcgaattatatagtcatggcgcagatcgaccagacgcacgttcgtttgccctacctcgtcaagaaccctgcgcgctatccgggagattgcctggggttgcatttgcttatggtagcgatcagagcagatcacgcagttatttgtggaattcccggtgagaaatgtccattttctgtacacggaacgcaggtaatctgccagcatttgagtaatgggaatcgtccgagctggcaactggagttgatttcgttcaaaatccacctgatcccaagtcaggttcgtgatctcatcccgtagcagtcccgcctgccatgcaagacgcacagccacaccggcggcatcgctggcgtggcttcccagaagtcgttccatggccgccgtatccggccgattcacaaaaaattctcgcatacggcccctccgtgccccgaattccctgcctgatgcaaatcgaaacttgcttgggcgattattcgtcgacggacgggcttagagaaacttcactgaacagttcctgccgcttccctttgctcgctgcctcgtcacggaattatcattccgtcgctgattcatatgaaagggattggcgggtcaaagggaaaagacacaaaaaaagcccgtactatctgcacgggcgaaaaaaacgatattagaaccaaggccggacagaatttaacgtttccccggcttttttctgctgcccggagaggcaaaaccctcttgtgggcaggcgccctatgtgataaaatgtaattgcagatatgtaggataaattgttttttgcgattatttgtgtcggaatgataattccgtgattacgatatcagccccagccggtcaagcgttcgctggtgctctgcgccagaagtcagcagatagatgcgcgtcgtttcgatgctgctgtggcccaacaggtcggacagtttgacgatgtcccgacaggcccggtaaaacacggtggcaaacatgtgccgcagattgtgggggaacaccttgcccggcatcacgccggcgtatttgcaaaggctcttcatctccgcccagatctggcggcggcccagttcttttccgcttttggtgcgaaagatcgcaccagaggcggtcttttgcttttgggcatatttgagcagcttgcggcagagtttccccggcagcaggatcacgcggattttgcctttgagggagacttcggccttgccctgccgcacggcttccactgtgatatagcggacttcgctgacccggatgccggtggccccgatggtctccaccagcaagcccagccgctcccggcccagacggcaagccgcgtccagcaggctctgataatcggattttgtcagctcccggccggcatcccggaacagccgccgctggattttcaggaatttcacccggcagtcgtttagatcaaggtacgccaacaggctgtttaaggcagagagcatggcattgatactggcgggggcgtagccctgctccgccagataggctttccactctgcggtcagctccttgcagatttcgcgatcacccagccagcaggcgaatgcccggatatcccgaagatacttttccatggtggctgcgctcttctcctccagcagaaggtgacgggcaaacgcctgtatttgcaggggtgtcagtttgtgttcggacatagggggcctccttgcatgatttcatgccaacattgtacaggaacggcagagacagcaaagcccacagcggtaactgccgctgtgggcttgtgaatcctggtcccgcaatggtaggattgccaccggtttccagaaaatatacgggttgccctatctgcttatcatgggattcttctcttcacgagttatggaagcaaatatgataccatactgctccagaggccgatgggaatatccgaaacacaacgaggctgcgtgcagaaaaatatgcgtaagctgttgattacgagtagattttgcctttgttcacagcatcgaaatgccgatggccggcagagcgggttttccttacgcaattcttctgcccctccggccgcgcaaagtgggtccgggcttccgcatggaactgcccctggctatagccggggacgatgctttccctgccgaaaggtggggggcttttgggatcgtccgccccaaatcctgtaaaaattctttttattcccctgaaacgatggtactctgaaacacgaatatacctgtgaaaggcggtgaggcgatggagcgggaacagacatggatcagggctatccagcggcgaaactcccgggaggcggcggagcagctgatccagacctactatgacgaaatctaccgcttcgtctaccgtcagaccggcagcaaggaggacgccatggacctgacccagtccgtcttcatcgcagtcctgcgggcattgcccggctaccgggcggagcgggcgtccttccgcacctggctgtaccgcatcgccgccaacaaagtcatcgacacccgccggaaggcccggccggtctctattcctattcaggaaatggagctccctgcagcagaggactttgtggcccgcgtccatgaccgggccctgctggagaccatcgaaggctatgtctccggcctggaccccggggagcaggcggtgttccgcctgcggatctacggggaaaagaccttcccggagatcgctgccgccatgggagagccggaggcggcagtgaaatccagatactaccgcctgatcgggcggctgcgaaaggagtttggagcagatggataatcaaaaaatttccatgcccacagaggcggaaaaacagcgggccattgcccggattctggatgcaggcctgccccgccgggtcgcctttggccgggagctgcgggaggttttgcagcgcatcggcccccgcgcgctgctgtttggcgtgggggactgtttggccttgtccctgctgatctgggccctgtgcctgctgtcggcgctttttgtggccggttccaccggctctttggcaccggccctgttcctgttttctcccctgctctatgccgccctctccctgctgactgcctggaagaacctgcagaccggcatttgggagtggacctggaccttccaggtctccgcccggatggtggcggccctgcagatgctgtgcttcggcggggtgtccgtactggtgtgtgtcccggcaaatatgctgttgtggaccttcaccgggcaggagatgcccctgggctggatgctggcactgtctctggccagcctgtttctgtatggcgctctctccctgctgtgccagcggctgcggggacctgccgggtggctggcggcgccgaccggctgggttctgatgggcctgattcccctgatctggccccggacggcggagtggctgacggccatccccaccgtagtgttctgcctgctggccgcggccgggattactctgtaccttttggaactgcgctgcttctgccggcgcccgatggaaggaggcgtctcctatgctctccgttgagcacgtcacgaaaacctatgggaagttcaccgctttggaggacatttccctgaccttcactcccggcgtctacggtctgctggcacccaatggggcgggcaagaccaccctcatcaagatgctcaccaccctgctgttccccaccaagggacagatcctgtgggagggagaagacatccgggccttgggggcggaataccggggcctgctggggtatctcccccagcagttcgggtactatcccagctacacgccccggcaattcctccggtatgccgccgccctccagtgcatcccgaagcgggaggcggacggccgcattgaccacctgctggagacagtgggacttggggatgctgcggacaaaaaaatgaagaagttctccggcgggatgctccagcgggtgggcatcgccgtagccatgctgaacgacccgaagctgctgatcctggacgagcccaccgctgggctggacccccgggagcgggtgcggttccgcaatttgatccacacgctggctgaggatcggatcgtgattctctccacccacatcgtctcagacattgagaccatcgccgggcaaatcgtcatgttcaaggatcaccgcctctactgctgcgacagccctgcccgcatctgcgcccggttccagggcagggtattccagcttcctgccgggatgcccctggccccgggacagttcctgctcagcgaaggacagggggcggatggcccggtgctccgggtgctctgcgagacgccccctgtcaatggaacgccggtaacgccggggttggaggatgcgtttctcgccatctaccgggaggaacagacatgaatctggcggtctatgagtggcggaagctcttccgcctgcccgccctgtgggccttcctggccctgtgtctggcctttaacgggctgctgatcgccacgctctccccctatgaccgggcgttcttcaacgagacttcccaaacggcaaaggccttgggccagcgggttgatgaagactttcttgccgggctggacgctatacccgccacagagaaccgggatttgctgcgtcaatctgtcaccgggatggaggacattttcgagacgtatgacaccggggaactctcggatttctatgccggtgtggtggagaaatcccctctggcagttacctggatgacctggaaatatgatctgctggcgagccgggtggagcacctggcccagactgacgcggcgctggatttgtacgccggcccggccacctacggcagccaccagttcctcttcggcgcgctgttccgggccattctctgtgagagcgccattctggccatgctggggacgctgtatctgctgggctacgaggggatgcaccgcgcagagggcctggcctgcgcctcccgaacgggacggaaactacggcgggtgaaggtcctggcggctctccaggcgtcggcggcgctgtacggcctgctggcgttctgcaccctggtgccctacttcctgctgtacgactacagcggaatctggaatgccagcgtgtccagccagttcaactatttctcggacatgctggtggtccggcccttcctcacctggggggacttcacggtgggtcagtacctggccgctgccctagccctgggcgcggtgctgacggcggtattctccctgctggcgtcggtgtgcggcacgctggtgcgaagcccctatctggcggccctggcgctgtgcctggtgtgcttcggcggactgggactggtctccgttctgggggagctgggctggtgggcggcctatttgattgcctgtttccagccggtaacggtctggctctcctgcagcgcctggttcacggagctgggactgaacgccgtcctcccctggcaggagaccatcgcaagcgggctgaacctgctgcttttgggcggcggagtcctgttggctctcggttggtttgacagaaaggacgtgtcctgatggaacttttgaaatgggagctgcggaagatctggcggcccggcatcctggcggccatcctgctgctgggggcggtatactactggatgttcccacagttctatatcgagcacttttgcaacggtccccagtcggaggcccagttcgatctggcctccgactgggtggagcggtatggccccaccctggaaccggaagaacgggcagaactggacgagcagatggcaggggagatcacggcctttgacacacagatcaccgccatcccggaagctgcggcagcggggctgacggactataaatcttttctctcctttcgggggactacctgaacggcatacgcaacactgatggacaggcagatatggatgtggaggccctgctctaccgggtgtacggcggcaccaactggtaccggatcgaggcgctggcggatactctggagacctatgatacccaggaggatcaccgcgctctgattgtctccaaccggcagcaattggcccagccggaggctatggtccggcgggaggcggagctggcaagctcggatatgacccattccctgctgccgtcctctgtgaaatactccactcaggagtacggcaaggatctggcggtatggtgcgtactcagcatcgtgctcctgctctcccccaccctggtgcgggaccggctgcggaacacccggcctatgcagtgggcctcccggcgggggcggtccgttttgaacgttcagatgggagctgccctgctctctgcgctggtgctggcggtggtgaatataacagtctatgtcattccgttcctggcccaggggcccctgcaatttgccgcctgcggcctggacggcatctgggagtggggcactccctggttcgactggacctacggcacctatctgctggtgctggcggggctgattttggccctgtccctgggggccgccgggctgacggcttttctctcccagtacagcggcaactacatcgccatgctgctgaaggccgttcccctgttcgtggcggtggggtcgtgctgggctcctggcttctggatcggcccttcacgttccgccccctctgggacggctacggcccctgggtgcccaagggtgcggaggcggtggccgctgcagtcctgctggctttgggacttggcctgtgtgccctggcctgccggcggcagcgaaagagggaactatgataaaggaaattttattttctcttaaattttatctctacaagtatgatccggattgtgacccggaacgatgaaatagcgcggagtggagcgcagcagccttcgagtcttggcccgtttggggtctaaaaacacttcggcgccggccgtccaaagtaggcgtgggcctctcagcgcttggctgctgccggcaagccaaatgctccgcgcgtcctgcagggagcggaatttaatgacattgggccaaagctccctcccgcctcattggcttacaggaggccagtccattcctctgtgccgttgtccatatcataactgtgagcgttggtggcctctataagtaggcccaatgggtcccttccacatcggagaaccgccgcagttcatcagtatggcggtccatatacgctgtgtcggcgctgcggcccaacattcggttaacgatggcagttacctgtgcccgggtgatagaatatatggccggaacgtaccatcgaaaaatccgccgatccagccgtactgggcggcgctggtcacttgggtacaaaaccagtcatcctcgttcgcgtcggagaagaggctggttccaccgggcgtctcgttggcaaaccgtatggcgatcactgcgaattgggcctgggtgatatcccgattgggctgaaatgcgccgtcggagtagccctgtatgatgcccagggataacagcagaggcgcgccacatatcatctggaacatctgtgcaacgtatcggtgacagacacgttcttttccaatagtaggttgtagaacatctgcgccgcctggccccgggtcatctgccggccgggggcgaaagagccgcctgtgaatccgtcgagataaaccgtatggtctctggtattcaaccagctggacacgtcggtgttatcaggatcggcgatcggctgagtggccttaaataccaccttgatggtgtggttggcccgcacgttctcaaaggtatagtgactgatagcgcctacgctctcgccatctaccagcacattaaaaatccggtaaccgtcgccggccataatgtggaaggcccggtcgccgccccggctgacgttggcgcgcccggagggggtgatggagccgacttggcctgtctcggcggtgatggcgcgggatccgctggtcctattgggccgcttttttctgttctggcagctcatcccaaccgacggccagctgctccgtgtccagcagacggtcgtaagcctgttccgccagcagccgcacgccgcggtcgatctctgcctgggtgaccagatacagctttcgcaagcaccggggattgcacttctccggcgctacacgggccgcaccagacagactctggatgtcccccgtcacctgtgtccgccgcaggggccgcctgcttctggtgacgaacaccggccctgccgtcagcccctgccggcggcaataggatagcagctctgcctgcagacaccttggcaactggacacgccgctgctcaccgccggagacagccggtgtgcgtccactctgcacggcctccacagtgatctgaggcagttctccgacgtgggctcctgtcagggcaattgctttcaccaaaagatacgttctctccttttccagcgcccgagcagcagacagcagccgcagatattccgttcgggtcagttccgactggggtgccgtttccgtctccagctgtccggtcagctgcagatcccggcggcccaagtagtccagcaggccgttagcggcggagatgtttgtgttcactgtggccggggcatatccctctgccagcagagcctgccgccatgtctccagagtattcaagacgatttgcttgtcaggcggcagatagtcgtagaatgtcttcagttttgcggcgtaaaaccgcacggtctcttcccggcgccctcggtgattcagatcctccaaataggcccggatgctctcttcacttaccgttacaccgattgctttcagcggtgctgccgccttttgacacaccgcgcctgttctctgcattgctcctccccctatcaacgaaatcaacattttgaatacgtccgcgggcaaagtaagacctggagcgcatgatttcaggagagaatccgcttctaaaacacgctccagacctcgttggggcagagaaaagagggccgagaaaaatcctttttcccggcctgattttgtgcgtcccaattggggggagtcccttgcggttcctttcaaaccgtgctataataaaagcaatttatgtaagaaaaaaggggccgttgaaattttttgtgacaaaatgttgattttgacctacgaaaccagccccagacgttccagttgccgggcgtgctccgctccggaggtcacaaggtagatacgagtggtttcaatggaactgtggcccagcacatcggccagccgcacgatgtccttgcaggcccggtagaaaatggtggcgaacaagtgccgcagattgtgaggaaacaccttggcagattccactccggcggacttgcacagccgtttcagctctgtccaaatctggcggcggctcagagaggttccgtttctggtgagaaaaatctcgcctgaaacggttttgtgttttctggcgtatttcagcagtttgcggcaaagcttgcccggcagcagaatggtgcgaatttttcccttgagggagatctcggtccgaccccgctgggcggcctccacggtgatataccgcacctcggacacccggataccggtagcgcagatggcctccatcaacagggccagccgctcctgcccacgcgctcttgccgcggccagcaaccgctcgtactcctggcgggtcagttcacggcctgcgtcgcggaacaggcggcgctggactttcaaaaattttgcccggcactcgtcccagcccagaaaatgaaacagtccgttaagtgcagccagcatagaattaatggtcaccggggcgtagtctttagagagcaggtgatccctccattcggcagccagttccctggaaactggtctgccgtccagccagccggcaaaggccctgatatcccggagatacttttcaatggtgccggggctccgctcctccctccgcagatgtgccgtatatgatgcgagttgtgccgggtcgattgtccgctcaggcatttctataacctcctacaaatatttttctttattttatcttgcaggaggcagcttatgcagtactaagagccctccaaagtccgttcaaagtctggtttcatttttgttttctgtagtatacgtgaacttgtaacgggcggtccgttatgcgttttttgctgtgtgttttttgaagcagatggccggccgatgaacgtaaagatttcagatattgccgctccccataaaaggcccggctgatagagcaattgggattctggttgcctctctgatccggcagccaatcaacttgtaagggtttggatgggacggattgccctgtgtgcctgccgcatttctggtcagagtgtcagtgcgaccggaggctgctttgctctgcccgtataggaaaatatggcctatacagactgcggtttgctgtttgaagccagtatggcatccgctatgatgtccgccatagttttaagaatagaaattttgtggaggaagtgatctgcgtcacctgggcagagcggcaagacgccaaaaccggtatttagcaggatgttcgcccctcctttcgttgtgatcttgtgcttcccatagcctgccccggaatgataaaagccgccgtagagtggacacgacctccgggggtgggcgatttcggggctaaacacacttggaaagcacggtgtatcggatggagaattctgcctcagcttatcacctgaaaggcgttgtacaggtccgcctccgcaaccgcaaaactgtctgatttgcgatcaatcaagctggttttcccggcttttggcatcaaaaagctcggaccagatcgggaggcacttccgcctgtcccgaaccccaaactatacaggacaaaaaacgaggctcagaagcattttctgcatctgagcctcctgctgttttcggtttcagaaccatttgccgggactttttccatggctttttccgcctcttttggggccgatggtgtggcgtgggactaggtgtccaaggtcaatcccacactgaaatatcagagtggcgaatgcgcggcgtaggtcgtggaacctcgctttcaacagccgcccgcttcagaaccccgtggaacatgtgcgggacgctgtacagggagaccggtccgccggtgtgggaggggaatacccaagggctgctgccgcttttcccttcggcctttgaaaaacgcccaagcgggcggcagatggccaaatagacacgcctctgcaacggcggaacgatggtccaaaaccggtcccggaccgcctggagaggaactctgcccatcccgcaaggcgcatagcggccgaaaggcagtcacgtggggcattacccgcgggtgttctgcggctgtttggcggagtgcccgccaatttctgccggatcggacggatggtgaaccgcgggctgccgtcgcgtcgtctggcggccctggtcatcagctcagctatctccgtggtgcggagaccgcgctcctccggctgacgatgcggaacaccaagaagtccgattcgtacagcgcttcgcagctgccggacggtagcacggcaagtacgatcacagttgtgcattgaggaacagcgtcaggtcatcgcggcttttgcaactggtccctttgacgtggcttccctcctgtcggcctgtttcttctcacagattcagacgtttggggcggcgcctgtgaaccgcctcgtttatacagaatcaggtgcctttgacgattccgaacaatagaatccagagacacatgcaaagtgaacgcgccttgatttgatgttctcgccaggaaacggtcctctgtaaaagtttactcttccggacgctctctgctttccgttgaaaatacgcggcccttccataagaaattgcctttgggaatgctgaattgaaatcatctctgttctatgcctctgttccgttcagcttccaccgggcgctctcactctggagctccaccatgcggcggtagaggccgccgcgctccatcagctccgccggagttccctgctcggctacatggccgttttccagcaccacgatgtggtccgccccggccacggtacgcatccggtgggcgatgaccagcaccgtcttgccggccagcaggcgggagagggctccctgcaccttggtctcgttctccacatccaggctggcggtggcctcgtccagcaggacgatgggggcgtttttcaaaagcgcccgggcgatggagatgcgctgccgctccccgccggagagcttcgccccgttctccccgatgggggtgtcatagccctggggcaggcggcggatgaactccccgcagttggcggcctccgccgcggcccgcacctcttcgtcggtggcgccccgcttgcccaggcggatgttttccatcacggtatcgtcaaagagcaccacatcctggaacaccatggagtagtcggtcagcagcgcctccgggtccacggtggagatgtccacgccgcctacccggatggtgccctccgtaacatcccacagccgggcggccagccgggcgcaggtgctcttgccggagccggagggtcccaccagagcggtcacttcaccctcccgggcggtaaagttcacaccgtccaataccttcttcttgtcgtaggcgaagcccacatggtcgaacacaatgtcgtggcccttgggctggaaacgctccactccctcggcggtgggggtgttatagatttcgttcatgcggtcggcagacacctgggacacgaacagctctgcaatgagggccagactctggtcgaagggggcgtacacacgggtgatgaccagcaggaacaaaaacagcagcatgaagtcgatctgtccggagacgatcaggctggcccccgccaggatggtggtggcgacccccaggcgcatgatgacgctggccgcattgacaaagatgccggtgcccagctcgccctggatggtgaccttctcatggtcgtcgatcttctggttgagcccggccagatagcgcacctcctggttggtggcgcggatctcccggacgttttccaacgcctcctggatgccgtcggagacacggattgcggcctgtttcgtccgctccgaggcccgggcggagatcttccgggtgccgaacagcaggccgaaggccaccggcaccccccacaggcaggcgatagtcagccgccagtcatataccagcaggcaaaccgcgataatggccgtggagatgtaggcgccgtacaggtatcccagcacatgggaccagacgtgctccatgcggttcacatcgcccatgagggtctcggtcaggtccgccagatcccgcttgccgaagtagcccaagggcagcttgcgcagccgctccgccaggctgaggcgggtggacttcacctcgttgtagaccaggccgtaagtggcgtggtactgctgcaggtgggtcacaaaggacagaatgacgaacgcgattaccagcccaagaaagagcgccgggccgggcagcggcgctccgtccgtcagggttcccatcaggccgtacatcaacaggtacaggatgcccatgccgtccatgacgaccagattgacaatgaccgtccagaaagcgccctttttggcgtttttcacgccctggtcggtgagggcgtatttgcgctgaaagtttttgccgaacatcttcttcacccctctctcactgttcgctggtgatcttccactggaccgcctggttgtaatccgcccacatccgggcatagaggccgccggcggcggtcagctcctgatgggagccctgctccgcaatgcggccctcctccaacacgagaattttgtccgcgcccacgacggtggacaggcggtgggcgatcatgataacggtgcggccccgggtcagctcagagaacgccttttggatcaatgcttcgttctcggggtccgcgaaggcggtggcttcatccaggaccacgatgggcgcatcctttaagatggcccgggccagggcgatgcgctgctgctcgccgccggagaggtaggtcccctcggagccgatcagggtgtccatgccctggggcagcttctccagaatgtccccgcactgggcggccatcagcgccgcgcgcacctgctcttgggtggcgtctgggcgggcggcccggacattttcaaagatggaggctttgaacaggcggctgtgctggaacacaaaggcgatctggtccatgagcacatgggggtcgatctgccgcacatccacgccgcccaccttcaccgcgccggaggcggtgtcccagaaccgtgggatcaggctggcggcggtggtcttgccgccgccggagggccccaccagggccacagtctgccccggctccgccgtgaaggagacatgggagagggcgggggtttccgcgccgtcgtaggtgaagctcacatcctcaaattccacacggctgctctggggggacttgggctgctccggcactttcagctccggggcgcacatgacctggtcgatgcgggcaagcgcggtgctggccagcatcatgcccgatgcggcgaacatgatcttggcaagtgccgtggagatgatggcggagaacaccgcgtaaaaggcgaagtttgtgacaaatcctgtgaagtcgccggcggccagagccccgggcgccaggaacagggccgccggtaccagaaacacaaaggcgccctcagtgaaggtcaggttgatggattgaggtgtccggcaaatatctgcctggtagtgctcggccttggtgctgtagtcctcaatagcctcctggaacgccttgaaggagtagacggtctgctggaagatcttgactacagggataccccggacgtactcagtgcctgctttggtaatgcggtccagggccgcctgatactctgccagaatcttggcgtttttgccgcccatcatggagaacatggccacaatggagatcaccgcagccagcaggcaggccgcccccatccgccagtcaaagacgaacatcatcaccagcatggcgatgaacaacgtgatggtacccacgatgtccgccaggttgtgggccagcagggtctccgtgtcagccgccgccgcgtccagccgcccgcggatgaggccggaggcgttggagtcgaaaaagcccagcggggccttcatcacatgggccacaccctgcttgcggatattggacgccgtgcggaaggcagccagatgggtacacatcaatcccgcaaaatacaggatgatgccggccaccgcaaaggcgaacgccagccaaccgtattgggcgacgctctgcgccttcgtccagtccggcgccaccgcgatcaggtcccgggctgccagccagatgcagatgtagggtgccatgctcagcagcatggacaccgccgacagggccaggcccagaaaggtcaggcccttgtggctgcctgcgtagcccaacaggacggccacatcactctttttcttctgcttcataaaaaacctccctctcaaagttagctaaaactaactgtcatccaaaaagacagggggctatccccccatcaatttcagccatccggcggtgtagaagtcccggagctgatccacatcccgcatcgcctggtcccggggcatgtcgtgaaccacgatctcaaagatgccattgaacatcccgctggcgatgatatggcacagggatttgtccagcaccgggatgtcccggcccaggcggcggagtacctccatgtaccgttgggtgtattccacctctgcctccaccatgttgtggacgaagtgctcatagctggtgccctccgcccggcacaggagcagcttgaccggctcccggtgggcacagatgtaatccaccatccagtggacacagccagaagactccacgcccatgtgctccggctgctgctcctcaggcagctcggcgaaggaggtctgggccgccatgaacttccccatgagggcggcggcatggggctccacgatagaggcgaacagggcctccttgctggaaaaatagccgtagaaggcgccggtggtcaccccggcattcttcacgatctgccgcagggaggccccctggaagcctttatccaggaattccgccatagcggcctcctgaattttttccaatgtggtaacagatgtttcttccactggaatctctcctgtaacatcgttatataacggtgttataatacaaccagccccacaatttgtcaaggggggaaagccgaaaaagcccggcgcaagtgcgccgggcttttcgatcaaaatctttgccctgatttgggaaggggcagagcacgcatgctgtggaggctgacgcccagagtggacaggttgtggagcatggccgatgtggccggcggcagcacacccgccgcgccaaggccgatcagcgccccgttgaacccgatgacgaatcggtagttggcttggatgcggttcatgagggccatggccagctgtcgcagctgcaccagctcccacaggctgtcggcggcgatggtgatatcggcgatctctctggcgatggccgccccgtcgctgatggcgatgcctgcatccgcttcggagagggcaggggaatcgttgatgccgtctcccaccatgaggactgtgtgcccctcccgccgcagggctgccacatactccgccttgtccgccggaagcaccccggcccggaagtcatctacccccagctgggccgcaatggcggcggcggtgcgggggctgtccccggtgagcatgacagtctttttcacgcccagtctccgcagagcggagaacacatcttttgcctcctcccgcagggggtcggagatacagatcacggcggagagcactccgtcgattgccaggtagagctgggagaactccggaggcagggtgtcgaacttttcctgctcgccttccggaatgcgcaccttctcgtcctcgaagataaaatgggcactgccgatgcgcacttgttccccatccaccgagctggcgatgccgtgcgccaccagatactccaccttggcatggcgttcctcatggcgcaggcctcggcggcgggccgcttccactacggcgttggccatggagtgggggaagtgttcctccaggcaggcggccaggcggagcatctccgcctcattcttgccgttgaaggggatgatctgggccacctggggacaggcgtgggtaagggtgccggtcttatcaaagatgatggtgtccgctttggctgtggcttccagaaacctgccgcccttgacggtgatgtgctcacgcccggcctcccgcatggcagacatgactgccaaaggcatcgccagctttaaggcacaggagaagtccaccatgagcaccgacagggctcgggtcacattccgggtgaggagcaaatccagcaggctcccggcgaaggtatagggcaccagcttgtcggccaggttggacgccttggcttcagcggcagacttcatctgctccgaccgctggatcatgtccacaatctggtcgtaccggccctggccggatgcttgcttcacctccagggcgcactcgccctcctccaccacggtgccggcgtacagcgcccctccgggacgcttggccacagggacggactcgcctgtgagggaggcttgattgacggtgatctcaccctccgccaccacgccgtccagagggatgacgcccccggcccggaccacaaccagatcgccgggcttcacttgtccaatggagaccagtacctcgtcgttcccgtttttcagccacacccggtctacgtgaagggacaaactctccgccaggtcggccacagacttcttccttgtccagtcttccagcagctccccgatctccagcaggaacatgacggtgccggcggtgccaaagtcccggcggcaggccgaaatcccgatggacagggcatccagcagctccaccttgatctgacgccgtcccagacagcgaaggcccttgcgcaggaaaggcgccatgtgccaaatcacccgggcaatccgcagcggcgcaggcaggaacagggtggccgccgcctttactgccaccttacccaccagtttctcctggaactcccggttcatagcccgggtgctgtgatcggggagggcgacagacgcttctgccccggcccaggtgaacgcgccgagtgcggagagaaccgtttcccgctcccctgtaaaggtcacgatgatacagcctgtgcgctcatggacagcggcttcccggacccagggctggcccttcagccaggtctccagcaggtcggcctgacgcaaggtcaggtttttctgccggaggcgcagacgtagccgcccccggctctcgtgtacgatggttgctcgcatacaggtactccttcctatgaaaaagggagccgctttccggctcccttccgcagcttttaagcctcctgaccctccacctgggtttcggcctccttggaggcccgggcctcattgatgtctttggcggaggccacaatgtcggcggcgttctcttggacggcggtgaccgtctccatcacgctgtccttcatccgcaggccggcggcggtgatgtggatgtaggcattcttggcatccttgctggtcagcagcttcacgccggcagagccgaacagagcaccgcccacaaagcaggccagtctgacgtaatgcttcatcataggattcttcctttccgtgattggttatttgcgtttgtaacctgtgatcatcaccatgatcatgcagatcacggcgccccaggcccagaagcgatgttgtttcatcaagatctcctcctgtctggaaacaagcccgtctcttcgcgtattaaagtattatagcagatgaaacgcccggtgtatcaccaaaacagacgatgttgtgccggttcagacatccttccggtacttggccggcgtcataccgtactgccggcggaaggcggcggtgaactggctggcactgccatatccgactgactgagccacccccagaacactgagggaggagtcccgcagcagctctgccgcccgttccatccgccgctgccgcagccaggcgtggaccggcaggccgtacagacggcggaaagcatccttgaatgttgtggcggagagcatggccatgcggctcagggctgggatggtcaggggatcggccaggtgatcctccatataacggcgcgtctttcctaaaacccggactacctcccgatccagtgccggggccgggaggacattcggcgcatttccctctggggcggagagcagatagagcagctctgccgatttccacacgcaccagcgggcctgctcgctctggggcaggcagtccaggttggcaaagaccgcccggctccaggtgctgggcccctctacggcacagccgttccggctggccatccatcgccgtacctgctctgtgtccagagagaggccccccagcagcgcacacagggcctccaggctgtcccgggcgctgcgggcgtccactgctaccaggactccctccaaggaggtgccgaccttggcggcggacaggctggaggcgtccgtgagaagaagcacctgccgggcacctgccgtcagggccgatccgtcccgccgggtcagtgttaccgtcccggcaacacagaacaaggcctcgaaatgcagaggctccagtcgaaggggcagggggagagggctcttttccagagagaacaggcaggcccggacgccgggcatcacctgcgaccagtctccacggtccgccagaacctctgccagcatccgtctgcctcctctctctgctgatctgtgtcccggccgcttaccggccgaacagccccttcttcccccagggctctttccgaatctcccctgcgtcatagccggtggcccggatggcttcccgcagggctgcctcatccaactctgtttctgcgatcaccgtggtctcctttttgctccgggacgaggtgactttcttcaccggaaaggctctgcgcaccgcgtcgttcacatggctctcacacatgccgcacatcatacctgtcacccgcacagtatatttccacatattctgccgcctccactgctgcttctattagttaacgctaaccacaggacaatcttctcctgtcaggggaattgtccagataatatcagtctggtttcccatgcaaatcggttaggcatatctaaccaaaaacattatagagccgcatcttctggtttgtcaagccccgggaccgcgcaagcattggcacccggcatggtattccggcaggggcctcttaaaaccggctacgaccgtctggcaaacggtacgcaaagtggctgctttgagagaggggcgaccatacaaaagcatttgaacggcgtggcgctcgaaagaggggaaattacggatgtgcctgccttttatcggcgtgttgattccgtttgcaggaaccgctttccggcctgcaccttactttggccggtgtcggagcaacggctccccgcctccgccaaaagagccggcaggtgaaagggccccacacccatctacgatgctccgccacgatggcgctggatgcatggtgccgggctaacaaggaacatgcccggaacgaaggactttcctgctctcgacggccctgcagattctgagccgtgtttcagcctgcggcccgatctccagttctgcagacgacggcagaatctcctggtcctgccgggctgacgtctcttccagctctgataaattcgtcctcgactatctgtctcttgcagtttggcctctttaccatggctgaaaatagcgattgcagtcctcttgggcctgcttcagcgcttcttctggggaacatacccccaaaactgcctgctggacatgggccgccagaatggtctctagttgcagctcgctgaagttctggtagtaagtgctgttgctgcggcgctgcgctgtgggaaagctctttcgcgcagtggagagccaggggtattgctcgctgatatcgcggttgctgtatgcggaacggcagggagacaggccgcccagcatcgtgaagaccggtgccaccaagtctgcatacagccactccaaaaacttgcaggcagccgcagggcaggtgcagctctgggcgatcccgatcacgccgccgcccaaaagcggctttccgccagggacgggggcaaagcccagcttaccagcaattcgggacatctgagagttcagaatgtgggaggcatagttgataaacaccacagtcatggcggccgttccatcggcaaagccctccagagcattcttccagaaatcatagatcgtccggtccgaataagaatatgtctcccggtagttttccaacgcacgcagcgcctccggcgtatccagggtgatccggccctgactatccaggagacgtccgttctccgcaaaaaggcggggcatgaattcgctggggcttacgacaacattgccgatggctaccgttgaaccgtactgtgtgggggaggcggcattgcagcctctggtaaagaaagacgcgacgcggttatagtcgcggaaggtcttggggacagcaagctcttcccggaagtcctcataatacatccgcttatatgtggggtcggtgaacagatcccgccggtaaaacagcagttggatgctgggatcatagggaacacagcagcggttgccgtgggcggtggtaaaatgctgccccagctccggaatggctttagccagcagcccgtcccaatcaaaggggatctgggcaaggggacggtatacctcctctccaagctcatccagccaggctacatccatgcggatcaaatcatactggctgcgggcgggagactggaccacccggtagacatcccgcagagagggcaggaccgtcagctccaggtggatgccggcggttttctcgagatgcggcgccagcctggccaaagcggtggtcgagggggaggccatggtcagtattcgtaaagtttgagaatgcagatggcccggcaccatctgcgcagtgcggaatccgtcattttccatacggagctttccgggcagggcttttccctgctccaggcgggccagcagctgtttcacaatccggtgggcaagttgcttgtagtccagttcataaactgaggtctccggatccgtcacagcggcctttgtggccagcgtaacaaaacgaggcagcggcgcctgactggagtaggcgcaggctgcccggacggcatcctctctgcggcgatccgagcatatcatataatcatacgcctggccgccgtcaaaaaacgcaaaggcccgcaggccgatctgataattgcggcagtccagaaagttgacggcttccttattctggcagtgcgtacggacacccctgataaacagagcagcatccggcagctccgcggcctctgtaaagacgccgattcgggcagcaccttgagagcagacatagtccgcaatctcccggccagcccgctcaggatcaaaacctgcgtacatcacatccggctgttccggaccttcccgctgcaaaaaaaccagcggcaggtccggagcttcggcccggtagtgggacaatgcatccgtcaggcaggtactggtaatgatcgcgctgaaacgggcgttcaatgcttccgtcagcagggacagttctctgctctccatagaacgggtggaatagagctgtacagaatatcctctctgtgaaaactcgctttgaaagacctcatacatagccgcccagtgggtgtactcgatccccggaagcataaccgcgattgcccggtcctttcccagccgcagactttgggccttggcattgaccttatagcccagcttttccgccgcctgccagaccaaacgaatcttttctacactgacatttccgcggccgttgatgacattggatacggttccgtgggagacaccggcctcccttgcaatatctttgatagtaggcatcccggcgcctccttccgctgatctgtttttattgtactatgtgagtttgttcctggcaagagcacttctcgccaaaacgaaatagtaaaattgaacagaataaggacttatattctatatgttttgtaagaaacgtgtaaatagtactgaaaaaatccaaaaaagaaattgacacgttccaattttggtggtacggtaacaatagaaactcgcaattctcagcttcgatttttcaattttggatgaaaaggagatgtcattgatgaagaagtttctcagcctagcactttctgttttgatgcttctgtcgctgctggccgggtgcggcggtggttcctccacagacgacggcgcccagcagaacggaggcagcgagacggcggagaccggtggaaaactggtcgtgtactccgcgctgaacgaggacaacaccattgcgatggcggagcagtttgaaaaggacaccggcattgaggtcgagtacatctccctgggcggcggcgacgctgtggcccgcgtccaggcggaaatgagcaacccacaggcggatttcctggtgggcggctccgtggacctgtacggctccctggcggaggctggggcgctgctggaatacgactcccccaacaacgatgacctggatgcgcgcttcaatgaccccaatcatctctggcagggctggtacatgggcgttttgagcatcatcatcaacgaggagcgattccaggaggaactggcctctcagggcctggcggagcccgccacctgggacgatctgctggatccggcctatgacgatgtatttgtctgggccaatcccactactgcgggcggtgcctacatcgccaccgcctgccagattttccgcctgggtgaagacgccgcctgggattacctgaaggcgctggaccagaacgtccaccactattatcagggtgccggggacgtcatcagccccgtggcaaccggcgagttcatcgcctccatcgcctgggcccacgacagcttcaagacccagcaggagggctaccccctcaagctcatcattccggagcagaccgcctatgagattggcggcgcggccatcatcaacggcggccccaacacagagaatgccaagatcttcatggactggctgctgaccaaggaggcccaggagctgaacgtggagtcctcctaccgctatcccgtccgcacagacgtggctgcacccgagggcctgccggcgctggaggatgtggatctggtggactacgaccgggaccaggccaccgcgatgcgggagtccgtcctggaaaagtttgaggcggaaatcatggcaaaccgcacctaaccggtagcaggaaagtgcctgcctgcaagagcaggcaggcacttttgcaatttacaattacggagctggaaggaggagtccctatggtcgcgggcacgtccgcacgggaatccgtcaaagaaatgaagcggttgaaaaatgaaccgctcctgctgctggtcatcatcgccattatcctgtttgtgggaatatttgtgatctatccagtggtcaaggtcatcctgttccccgatggggggacctatctggagctgttcaaccggccccgctggctcaccgccatcaaaaacagcctgttcatgaccctggtctccaccatctcctgcacggcggtggcatttctgttcgcctatgtcatcgcccgcctggatgtgccctgcaaagggctgttccgatttattacactgcttcccattgtctctccgccctttatcgtggcgctgagctatatcctgctcttcggcgtccaggggatcatcacaaaaggcctgctgggactccatgtggatatctatggccgcctgggactgtggatcgtccagactgtcaccttcttcccctacgcctactcggtgatctacggcgtgatgaagggcatctccaccaatctggagtatgcagcctacaacatgggcgccacccggtggcaggtgttccgggatgtgttctggcccctgtgccgccccggcgtggccggcggcgccctcatcgcggccatcaacgtcctgacggatttcggcaaccccatcatgatcggcggcgatctggccctgctgcccacggaggcgtatatgcagatcaacggctggtacgacatgagtacagcttccgtcctggcggtggcactgctgatcccggccgtggcgctgttcctggtgaaccgcttctgggtgggcaggcggtcctatgttaccattaccggcaaggagatttcgctaaatccctttccggtccccaagtgggtgaagtggaccctgttcacgctgaccatgctgatctccctgttcgtccttctggtgtacggcacccttttctacggggccttcaccaagacctggggatatgactggtccttcacctgggagaacctgcagtacgtgttcctgaaaggggaacagatctggaactccatcaaatacggcctcctggcgtctttaggcgccgcgctgctggccatggtcctggcctacatcgtacagaagaagcaggtaggcctcaacaagtttctggacttcctggccatcctgcccggtgccattcccggtatgtttctgggcatcggatttgtgctggcgttcaacggcggctggctgtccctgacggggacgggcgccatcatggtgctggcgctgctgttctggaatctgcccacctgttacagtgcggcaacagcaggcctgcagcagatcggcgcctcggtggaggacgcggccctgaatctgggagccaacagcttccgctctttcaaggatgtcatcattccgctgctgaaggcgccgtttctctcgggcttcgtgctgtccttcctgcggtcggttacctgcctcagcgtggtgatcttcctctacgcgccctccaccaccgtgggcaccatctctgtgatggtcctcgtgcagagcggacagtggggcgaggcggcggcgtttactgtggtgctcatcaccatcgcgtttaccgtgctgcggctggctcagtggctcctgggccgccagggcatcaagctggaactgtaaagggaggcggaacgtatggatgcttatattgaatttcggaacgtcgtcaagaagttcgacgactttgtggctctggaccatgtgtccttacagatcccaaagggggcgttcgtgacgctgctgggcccctccggctgcggcaagaccaccctgatgcgccagctggcggggttttccgagccggaggagggcgacgtcctggtggacggcaagcggatgaacgggttgccgcccttcaagcgcaatacgccgctggtgttccaggagtatgcgctgtttccccacatgacggtgtatgagaacatctcctacggcctgaagctgaaaaaggcgcccaaggaggaaaaggaccgcaaggtggcggagatgctggagatgttcaacctccagggactggatgggcggttcccgaagcagctctccggcggccagcagcagcgggtggcctttgcccgggcgctggtgatggggcaggagatcctgctgctggatgagcccctcagcaacctggacgccaaactccgggtggaggtgcggacggagctgcggcagatccagcagaagttcgggatcaccaccatgtacgtcacccacgatcaggacgaagccttgtccatgtcagacatcatcgccgtgatgcgcaggggccgcatcgagcagatcggcagcccctgggaaatctacttccgccccgccacccgctttgtggcggacttcgtcggcacggtgaacttcctggagggtacggcccatcgggaggcagacggcagcctgtccgtggaccacaggggtatgcgcctccgggtggacgaggacacggaccttcagggcggcgagccggtgactctggtggtccgcccggagggtatcagcctgatggggctggaagagactgtcccggagggcacggcgctgcgcggcaccattgaaaattacagcttcctgggtcgtatgatccgctactgggtgcgggtaggggaggaggtctttgtcattgatgacgccaatgtggacctcaccggcgcccggacaggggatgtgcagcttcgtttggatactcgcaagctccacgtgctgaaaggcggtggtgcggatgctgctggttgactttatcaatgtgggctatggcgacgcgatcctgctgcgggagacggagacacccttcgccatgctggtggactgcggggacgctcgcatcgggcgctcccgaccggacggacggcggatcactgcggcggactacctgcgccgggaggggatccgggagctggacctgctggtgctgacccacctccacctggaccacgccggcggactgactcatttgctgccgggggtccgggtgcgggaattctggaccaactacctcccgccggaggagatgtgggggcacacactcccggcagtgccgggagctccagccggcgcccggtgtctgatgacctctatggggatttatgtaaaagccctggctcatctgcgaagccagaagacggagatccggctgatccggacgccctgtgattgccggcggctgacggagacattgtctgccggtgtttttctggaggatgaagaactccggctgcggcaggcttccatctgggacgccgtcctttctggcgcgggcagcagcggggacctggaggcgcttgacggctttatcaacaacaccagtatccgcctgcggctatcctatgccgggcaggagattgagctgccgggggatgtgtatgcctcctgctgggagcggcaccagctcccgccctgcaccctcataaagctgccccaccatgggcacggggacgccttgacatcccgacttctggagatgctgcggccacggtacgccgttatctcggtctcggatgatcggacagatgactgccccagcaaaaaaattattcagcttttgtcgcagtttggcgttgaatgcttttttacggatgcagtaccgtgtcagtatgctccggatcagcctcatgttgccatacgttttcggattgaaaagggagttcttatggtatcggacgtgtaaaaagatgtggggggagggaaccgctctgaacactggaccccaacgatttatcaggatgtgaacgactcctgcctgacgcacgccgatattcccgccaggttggattacaatggggactggcgcggagacaacaagtgagagaatctcaaaaattattcccggattccttctgcatattgttctatatgagagactttgttccactattttatggaatacgacgtttattacccgcggggcataccgagggcatcttgacagcatttcccgtatccaaagcggttgtaacctggacggatcagcccatctccactgatggggtacaggtttccgccatcatcgcgtgtcaatgcatgagccggaagcggcttacgtgcagactgcagggcattcgggcagaaatgcgattgcggcttcgagaaaagggcaggcgcttcggcgcctgtcactttcctaaaattaggaatgcgcacaaaaaatcaggatatgtacgtggaaggagtgccgttctgcccgtcgtggcgggatagaatgctgcttccggcctgacgcctgctgtcatacgctttctgcttttttgcgtcacagttggccgacgcgatgccgcccggaggagactctgtgttctcgtaccgcgacgttttttgccttttacggggccatgtaaaacaagctcaaattggtctggcagacccaacctggctttatagctgtttgaaacagcatcggctcatagatggaaatctcgggcttatctctgccgcaccttgagcagtgggcattgcccctttttctctgccttttcaaagtggacacaggctaccgcctggtattgcattccgcttctctcccggctgatttccaaagaaatcagccgggtttcctgcgccttcaaagaattagatggtatctggaagaatttttgcgtggttttgccgtattctgagctgctgtgataagcatttgttggcttcatagccgagacgatgatctggtgaatgctttgcgctgtcttagggctcaagcccttgaatggtctcttgctccggttccagtccacccggcccttttccgtgtcgcttataccttttacagcaacataacagatggcaccgcggtgtcattctcaaactgctggttttaaatacgacagaaaaaatattacgttaaaaaatatggcggctgaggagcgggtttatcactccacagcctgcataagcatataagcattacttatgcgctatacgtactgtttccaatggagagacggaggggggcggcgcgcttccccggcttcatccagctaaaaataatttgattcaaaataatattatgtcttattttttgcttgttttctgcgaagtcatgaagtatgataggggtgtaagagaccggcgtcctccaaaacggtatataccgtttttatttccgctttgcggaaataaggagctttgttttccggcgaaaataacagaagaaggagcgagaaagatgaaaacaggtaagaaactgctggctctgctgttggcggtcgtcatgacgatgagtctgctgaccgtgggggcgtttgcggaggagaccccttcgtccgagacgcctttggagcagcaggattccggcagcgggaacatcccggacgatccggcagagggacctgcggatgacctgacaggcaattctgaggatggggccgcaggcgagtccgacgcagccctgacggcggcagacacttcgtatgtggcagaggtcgacggtcagcagtatgaaacactgcaggctgctgttgacgctgtgcagggcagcggcacgattgaattgacgagcagtattgcattgtcagatcaggtgaccattgacagcggaaagacgatcattttagacatgaatggtgagacgttgtctattggcttttcggacagcagtaaaaatttgatcgtaaacaatggcacacttacaattacaggcgacggtacctttgatgcaactgaggcgacaagctacaagggcttcatcaataactatggcacgttgactgtggaaaacggaacatttcagatagctgataaagccatgaccgttcatctgagaaatcaggatggcggtaaggctgtgattaatggcggaacttttagcggtggggcaacgattgttcgcagctttgaaggctccaatacgacaattaccggcggaagctttacaaatagtgtttatcccgctgttgatgtaaacggagaaacgctgattaccggcggaatttttacgaatacgtcttgcagcaggtgcgatagccaaaattggggatatacggtccgcagcggcgtggacaacgatcctgatgccaagctgacgattacgccgtcgtctgagggaagcgttgttgtgaccggcacgcagggagcccttagtgcgaccgctgggacaatggaagtcaatggcggcagctataagacggtagattgcgcccagaagcatggcgctgtattctatgcgctttatgtggccggagaagccggtgccgtacaggttgttgtaaatgacggtacatttgtgacggaggggaagcagactgccgttctggttggaaacagcaacgacgggggcctgaaagaacaggcgggtctccaaatcagaggcggtcaattcagcgcacctgaaggaattccggcctacaaggtagatgtagccttgggcggattgaacatcactggcggcacattctccagcaaagtcgatgaacagtatctggccgagggctatgtgcagaacgccaacggcgaggtcggctcccgggaagagatgatggttgccgaggtcacaaccgcagagggggtggaacagtatacctccctggcagaggctgtggaagcggctgcggacaagtctgtcattacgctgctcaaagatacagagggcgacggaattgtgatcgatacatccaaaaagaacctgacgatcgacttcaatacccactcctatacggtcagcggaagcacggtggggtcttccggtacagaaaccaacgcgtttcagttcttgacgggtggttccctgacgctgaaaaacgggtccatcatctttgccaatcagaagaccctgctgatcggcctgcagaactattgcaacctgacgcttgagaatatggtgattgatgccagtcaggcaagcgcaccctgtcagtatgcgatttccaataactgcggtactgttcagtttatcggaaatacgagtataaaggcatataaaaaccaaacggcttttgattcctgcaagtttggcagttacgagattcccacggtgaagatcaataccacaggcaccattaccggcgatattgaattgagcggcggcaagctggagatttctgccggcacgtttgagggaaatattcgtacggtcagcggttacgcaaagggtgatgcaatcatcaccggcggcacgttctccagcgatgtgagcaagtatctggccgagggtcttggacaggatgccaacggtactgtgggcaaggtcgaagagggatttgctgccgtcagaatcggcgatacctattatcagacgctggccaaggccatcaccgaagcaaaagaaaatgataccatcacgttgctgagagaggtggatcttggcagcgacagagttacgatcaacaaagcggtcactctggatctgaatggctgcacgcttacaagttctaacgcgaccaatacgctgtggctggaagccagccgtgtgaccgttcaggacagcaaggggaacggcaagatccagaatactggctccggcagcaacaatattgcagttgttgtcaatggtcagggcactgaggcgtatttcaaaagcggtacggtttccggcaactatgccgtctttattcagaacggagcaaaggccgtaattgacggcggcaaatacacaggcacctatggtatcaacacagttggtacaagtgatgaggcaaacaaaaccgctgtggagatcaacggcggggagatacaggcggtcgcatttgcggttgccggaaatggctctgccgactatacggagacagtgattaccggcggcagactggaatccactgagggaaatgtcatctatcatccccaggtaggcgacctgacgatcaagggtgatgcagaactgatcggcccgaacggcgtgcagtattgcggcgccggtacgctgaccattgctgaaaatgctgtgattaccgcaacgctgccctttacggaatttcccaccaagcccgcttcccagggggatggcagcaccgatgatggcgcggccctgtctgttgtttcccgcggcggcggttatcagggcgaggggcagaccatgaccgtgaatatcaccggcggtacgctgaccagccgcaacaatgcggcgattgccgtataccgtttggaacgtgtaaacggccagtggacaacaaatgagaataccaagattgtcagctaccttgcggcgctgacagtcagcggaggcaacttctctgccggcagcaaaaaggacgcttttgagattgatacccaggctgccgacaaaatcagtgttaccggcggctacttcacctctgatcccagcgattacgtaccggaaaatgcggaacccaagctctttgtggtcgcttccgacaagacgggctacgcctacatggtgaccaccacgaagcctacggaggtcgatcccattgtcacggagaagacggagactgaagtaagcgagagtatcgagctggaagaccagaaaaagatcgaagcggtcatcgacaatgcgcaggtcagcggcgtttctgacgcggtgacggagtccgcgcagaatgccattatcaatcaggtggagggagaactgaagcccgaggacaaagtggtggtggagatcaccgtgagtctgaccgccgataaagcggatttgaccacagcggacaagatgtatgtctcctataaggcagagcctgtggcgaaggtcatagtcaacgacgaaagcgtagggaaagagattcccgtaaccaacgactatctggacggccagaccctcattgaggtccgcctgccgattccggcggacttggagccccaggagatcatgcacattgcggatgacggcacccgtgagcgatatctgaatggttccggcttcactgtggaggatggctgcgcggtgctgcatgttaagcatttcagcacctttgtgctcaacggccagctgacagttgccgccaagatcggtgagagcgagtacggcacgctgcaggaggctgtgaacgccgcgaagtccggcgataccatcgttttgacgcaggattgtgacgagaagatctctgtctccggtaagagcgtgaccattgacctcgatggacacacttatgataaggacaagatcacgctgggcagccgctgcagcatgagcgtgagcgatggtaagatcacgattacttattccgctccctccggcggcggatcctcttcctccagcagcggtgattataccgtcagcgtggagaacagcaagcacggcaccgtcaccgtcagtcccaagcgggcggacaagggcgataccgtgaccatcaccgtcaagcccgacaatggctatgagctggacgagttgactgtcaccgacaaggacggggacactgtgaagctccagagcaagggcggcaacaagtacacgtttaccatgcccggcagcaaggtcactgtggaggccacattcactctggagaaagaggagaacctgccctttgccgacgtggcggaggactattgggccgtggaggagatcacctgggcctatgaaaacggctatatgaacggtgtcagcgccgagcggttcgcccccggcagcacggtgacccgccagcagctgtggatggttttggcccgtctgacggagttcaatccctccaacatgaccgaggcgcagcactgggccgtggagagcaagatttccgacggcagcaaccccggcggcgccctgacccgccagcagatggtgaccatcttgtaccgctgggcgcagcagatgggctatgacgtgtccgggcgggccgatctgtccgcgttcccggacaacgcctccgtggccgcttacgccacggaacccatgacctgggctatcgcagagggatcatctccggcaccactgagggcctgctgaaccctgccggcacggccactcgcgcccagtttgcggtgattttgtaccggttctttgaaaatgtgatgtaagtaccatgctttgcttcagggcggtccttcggggccgccctgtttttctgtccgatggcgggatgcaaagccgtcaagatacgagatgaatggatatatctcctgcatgtgccgcaatgtctatgaaactccctgggacgcactgtgcgtcccggggagtttcgggcatagaggggcgtcccatgaagtcgctggccgtacggcaggacacggcagcgaggggccagacaaggagcaaagagggatccattcaaccgttaggccggcggcggttcctgaaatagagccggagggcggcaggcagacgcgatccgcttctctgcatgtcagctttgacggcccaaggcaggaggctggacctcgtccggaactgccgctgacatgcagatggaggggatgtgttccttcccgagggggacctgctccttgatggaagagaatccttccagcacagctttaacttcgattttacaaacagggggtggagcgacccccgcctctccctttatactggtatcaaccgacgggccggccttgttggagaaaaatatttcgcctcttctacaagcggccgattcccgctgaggggggcttttcatgagaacaggcaccgccttgtaagtttgctacgggataggagagatcagatcatgcggcaggatattcgggttttggaccgggtgcgcggcgcctacgcctccctgcggccatcggagcagcgggtggcggactatgtgctgaaggacccggagacctgtacccggtgcaccatttcagagctggcagaccaggtgcaggtgagccagcccacagtgatccgtttcgtgcaggcccttggatttgacggctaccgcaacttcaaatactgcctcatccgggaccgcagcggcggcgcggcccgggaggcctgcttcgaccacttgggaggcttcgacttgaagccctgggaccagctggaggacctccccctgaaagaggttcgggtgtccggcggcctgctggaggaggcactgaagtccctgtccgtccaggagctggaccgggccgtgcggatgcttgccactgcccggaccatcgacatctacggggtggagaactcctgcacgccggccagtgatctcctgaccaagctgacctatctggggctctgctgccggatgcacaccgacgcctatctccagcagatcgccgccgcccatctgggggtggcggacgtggcggtagccttttcccactccggctgctccatggatacggtgaaggcgctgagactggccagaagggcgggggcaaacaccatcgccgtcaccagtcggaagaatcctctcttggccaagtacgccgacgtgtgcctgtataccgggggagaggacactgtgatctacggcacagccatcttctcccgcattcccgatctggcggtggtggatctgctgtacatggggatcattcagagcgactatgagcggttctcccgcagtctggacaaaagcggagcggtcattgccgaccgaggctatccggaggcgtgagattccccggcgggggctttctttgtaatttttctacaaggaaggccccctgtttttgatgcctttttacgtttctctaacggaaaattaaaccttttacgcttgttttgcggagctggaatttgctaggattacaccgtcgccggacgtgcggcggcgcccacaagaacttttgaaaccgagaaaggagcggtttttcatgctggaactggagcatatccagaaggcatttgacggcgtgcctgtactcaaggacctctctctccaggtggaggacggagagatcgtctccatcctggggccctctggctgcggcaagaccaccctgctcaatatcatcttgggcatcgtggatgccgaccagggagagatccgatacagcggggaggatctgacccgcacccccatggagaagcggggcttcaacatcgtctttcaggactacgccctctttcccaatttaaacgtacagcagaacatcacctacggcctgcggaacaagcccggcatctcctcccgggaggaggtggatgagctcatcgacctgctgggcctgcgggagcacctgggcaagcgcatcgaccagctctccggcggccagaagcagcgggtggccctggcccgcaccctggtgatgaaaccccggattctcctgctggacgagcccctgtccgccctggacggagtcatcaaggaatccatcaaggaccggatcaagaccatcgcccgggagtaccacctgaccaccatcatcgtcacccatgacccggaggaggccctcaccctgtccgaccgggtgctcatcatcgatcaggggtccatctcccagtacgccaggccggacgagatcgtccaccagcccaggaacgactttgtgcgcaagttcatcctccgccagctggagatcaagcgcggcaatatctacgccctgttcggcgaccgcccgcagctggccggcgaggctgtttgaggaaaggcgccatgagacggaaaaattgggagctgaaggggattttctggatcatcacccttctgttcgtgggcttcctggccgcccccatcctcctgctgctgggcaagtccctggtgggggagggcggatttacctgggagttctatgcctcggtggtgacccgggagggatttctcacggcccttggcaacagctttgcggtggcggccgcatcggccgtgacggccacggtcatcgccttcctgatggcctatgcggtccactacaccggattgcccaggtgggccaagcggctcatcaccgccatcgcgaccctgcccatgttcctgcccaccatcacctatggctttgccatcatctactccttcggcaaacaggggctgctcacccgcctgctggggcggcagttctttgacatctacggcttcggcgggctgctggtgggctatgtgatctataccattccggtggccttcctgctgatccacaacaccatgggttttgtggacaaaaagaccatcattgtctccaaggccatgggggaccgggacctggccaccttctggatcgccattcttcgccccctgctgggaactctggcgggcgccttcattcaggccttcttcctgtgcttcaccgacttcggcatccccgcctcagtgggcggcggctatgaggtcatcgccaccctcctctacaaccagatgctgggcggcatccccgacttcaaccggggggcggtcatcgccatgatcctgctcatcccctccatcggcagcatctgcatcctgcagctgctggagcggttcaatatccgctatacccgcatctcccaggcggacctgcggaagaaccccctgcgggatacggggtggggcgtctccagcacggcgatctcagtggccatcctgtctatcttcgcggtgatctttgtggtccccctggtggaggagtggccctatcagaccagcttctccctggagcacttcgccgccgtattcaccgacagcgagctgattaccgtctactggcactctctggtgatggccctgctcactgccttcctgggcactctggcggcctacggcgccgccctcatcaccgcccggagcaccttgcccccgcggtacaagcgggtcatcgagagcattgccctggtgaccaacgccatccccggcatggtgctgggtgtggcctatctgtttctcttctccggcagcggcctgcagaataccctgctgctgatgatcctgtgcaacatcgtccactacttctccaccccctatttgatgatgaagaactccctgtccaagatgaacgccggctgggagaccacagccatgctcatgggggacagctggctccagaccatcctccgggtggtcacccccaacgctctgtccagtctcatcgaggtgttcagctactacttcatcaattccatggtcaccatcagcgccctcattttcatcgccggggcccggaccatggttctcaccaccatgatcaagcagctgcagtacgtgaaccgcttcaacgaggtgttcgtcctctccctgctgatcctggccactaacctgatcgccaaggggctcttctcctgcctggccagctataaggcatcccatccggtgaaagagcgccgttccatccaactctttggaaacagaaaggaagcagtccaatgaatttcaaaaaatacctcgccctgggaaccgccctgaccctgacccttctcgccggctgcggcagctccggctccggcgatgaccagatcgtcatctactccaacgccgatgaggaggccgtcactgccatggagaacgctctggacgcaggcggctatgagggcaagtatatcgtgcagacctacggcacctccgagctggggggcaagctgctggccgagggcaccaacctagaggcggatctcgtgaccatgagcaccttctatctccagagcgcccaggagcagaacaacatgttcctgcccctggactttgaggtgaacaccctggaggaggtgcctgactacaccgcccccatcacctcccaggagggggccatcatcctgaacactgagctgatggcctcagagaacctgcccactcccacctgcctgaaggacctggctgacccagtgtacgccggacaggtggccgtcactgacatccagtcctcctccaccgcatggctgctgatccaggccctggtggacgcctacggcgaggacggggccgaggagacgctggccgccatctatgacaactgcggcgcccacatcgagacctccggctccggccccctgaagctgtgccgggccggcgaggtggccatcggcttcggtctgcgccaccaggcagtggccgacaaggctgacggcctgcccatcgactacgtggaccccacggagggcaacttctcccttactgagtccgtggccgtcctggacaagggggaggacaccaaccccctggccatggagatggcgcggtgcatcatagaaaacggccgcgccgagctgatccaaacctacccgaatcccctctatgagggcgagaccgccgaccccgccaaccagtccgactaccccagcatctttgacgagcccctgaccttcgagctgttcaccgcccaccaggagctctccgaacgggccaagggctgaactggcttgtctgtgagaaaaggaggaaccgaccatgaatacctataaactactgacccccgggcccctgaccaccaccgacacggtgaaggaggagatgctggtggaccggtgcacctgggatgacgactacaaggccgtcacccagaagatccgccgccagctgctccagctggggcacgtgtcggaggatgactacacggccgtcctgatgcagggcagcggcaccttcggagtggagagcgtcctctccagcgtggtgggggacgaggacaaggtcctcatctgctccaacggggcctacggggtgcgcatgacccggatctgtgaccggaaccgcattccctatgtccactacgccgagagttatgaccacatccccgaccccgcccgcgtcgcccgtctgctggctcaggacccggccattacccacgtggccatggtccacagtgagaccaccagcggcatcctcaacgacatccagtccgtgggcaaggtggtccgggacgccgggcggaccttcatcgtggacgccatgtcctccttcggcggggtggatatccccgtctccgactggggcatcgactttctggtgtccagcgccaacaagtgcatccagggagtacccggcttctccttcatcctgtgccgccgggacaagctgctctccagcgagggcaaggcccgctctctgtccctggacctgctggaccagtggaaggggatggagaaggacggcaagtggcgcttcacctcccccacccatgtggtgctggccttctccaaggcactggacgagctggaggcggaggggggcatccccgcccggcaccgccgctatgccgagaacaaccgcctgctcattgagaagatgcgcgccatgggatttgccccatacatcgacgggagccgacagggccccatcatcaccaccttcttctatcccgccggggtacccttccagttctccgagttttacacctacatcaaggagcggggctacgtcctctacccgggcaagctcaccgatgcagataccttccgggtgggcaacatcggagagatctacccggaggatattgagaaacttgcttccatcatcgccggcttcctggctgcccataaggaggagatcgcatgatccaggccgtcatctttgactgggcgggcaccactgtggactacggctgctttgcccccgtccaggcctttcaggaggccttcgcccaccacggcgtgccggtcaccctggaggagacccgtaagcccatgggtatgctgaagcgggaccacatccgcaccatgctccggatggagcgcatcgcccgggcctgggaggagacccacggccgccccgcgggggaggaggacgtggaggctgtgtacgccctgtttgagcccaagctcttctccatcctggaccggttttccacacccaagccgtttgcggtggaaacagcggccgccctgcgggagatggggctgaagatcggctccaccaccggctataccgactccatgatgcacattgtcgcacccaaggccgcccggctgggctacgcccccgacttctggatcagccccgacggggtgggcggcaggggccgtcccgatccctacatgatctttgaaaacctgaaggcgctggaggtccccagtgtgaagaacgccgtgaaggtgggggacactgtctccgacatccgggagggggtcaatgccggcgtgtggtcggtgggggtcatcgagggcagctccgtcctgggtctgagccagacagagtacgaggccctcactccggaggagcgcagggatgtctgccgccgggcagaggagaccttccgcgccgctggagcccactttgtgctgaacgatttgtcccagctgccggagctcattcggatgatcgggtaatcacaacccaagtacatctcaactgatgctgcccccaggccatgcagatggagaaagcgacagcagcccataacccgcaggccgttggttcaaatccggccccagcagccacaaagccgtctgattttttaagaaatcagacggcttttccgtgcataaagagaactgccggaacagccggaggttccccaaagcctaagctctgaaaaagcatcctcctttgctggaatggaagagagctgccaaccaccggaacgaacaaaaggaggaatcaagtccggatgaaatctgaatgggcgtcatcaatgaatggatttggcagttaagtgagagaaaggcaagggaccttctggaaatcagctatgtgggccgtagacgtgtctcctaccatttccggttctcaattcgagccgattgactggactgaaaagcgctcagaagcagccgttgcaggcactgggccggactgtgctgcccacgattctcgtaccattaagattttgccggcaggtcagaagaacaaactctctatgtgagaggtgtgccggctcccgaagtaagacttagcggccttcggctccaggtttgtggctttgcttggccggaacagcgggatcctccgccggactgattgcgcccgaagaccccaatatttcatttccgggcattgaatatttcgcctcacaaagccgtcgccccgatagctctctccccacgaaccgggacgatggaggggcctgtccgtgcggcggtttgcatatacgccgacagccggaaaatccgcaaaaatgattcagcaccttttcttttcgacaaaatacgatataataaagaaaaacgcctgttccacagccgggacgctgcctctccgtttgcatggaatggattcggtgggatttgccggcgggagctgtttgaaattcagaacactgcgtatggggaggagactcatgatttcgctgtttcttgttgaggatgagcggattgcccgggagagtatccgagacaatgttccttggcaggaacacgatatcctgttcctgggggatgcgccggatggagaagtcgctctgccgcagctcctggaaaaacggccggatattctgctgacggacatcaagatgccgtttatggacggcctggagctggcccggatcgtgcggaaggagctgccggatacccgcatcatcatcctcagcggacacaatgaatttgaatatgccagaaaggccatcaccctgggcgtaaatgactatctgctcaagcctgtctccagcagggatattctggaagccgtggaccgcagcaaggcgcagattttggaatgccgcgcacggcggattgagcggcagagccatagcatcacacagcgggagctctttttcagcaatctgtacagcggcatcctgatgggaccggcgcagatgctccagcgtgcggcgcagcttgggatctctttggctgcaggagcctaccagatcatcctgacggagctggacggtgtgataccggatcgggaggcgctgcgggacaagctgtatgccgcgccaatggcatacggctccggctttgatggggagcgggccacgttcctgctgctggcggaagacgcggccgggcttcccccaaaattgcgggagttctctgcatggctggaggcgctggccgggcaggagggactgagcgtgcatctgctgcctggaaaacaggcggcccggctcagcgacctgccgaaagcataccatctgctgacgattcagaaaaagcagcgggagtccgcagacagcaagacgctgtcccactccacctccttccagcgggacaccctgctggactttttgcggactgggaagccgtctgcacttccgtcattttgggcccactaccggccgaccatcgagtccgggtattcctcctttgtctatcgctgctatctctatacagagcttttctttgtggtccatgagttctgccaggaaaaccggatcccccttccggaatccctgcgccaggaggatctgctggaaaagcgtattctgctgacgaattccgtagatgatttcctgacgctggcttgccagctctgcgaagaggtgatggaggtccgccccgggggcagccggcacacgccctccgcagagcaagccagagcgtatatcgaccgccactatatggacccggagctgtccctctcctcggttgcgaatgcagtgtctgtaagccccaaccacctcagcacgcttttcaaatccaaaattggcgtcgggttcagtgaatatctgacggaggtccgaattcgccaggccaaacgcctgctgattaccagcgatctgcgggtcagtgaggtcggagaacgggtggggtatcagaatatggagtatttcagcatgctgttcaagaaaaacaccgggcagacgcccagccagtaccgccgctcccacacgctatgagacggatgagtcgtgcagccggcgccctgaaaaccgccctgggccgccgtgggagcatacggagcaagatcctggcggggtttacggtcatcctggtggggatgttgagtatcaacctgctggttatcggcctgtcccaccactttttgggagaataccatatcctggcggagcgggtcatttccgcaaacaagctgatccccactgtccgggatgacgtgagcctggacgcctattatctggtggcggggcgccgcaccctggagacgacccagctcttccaccacatggaggaaattcgccaggggctgtatctgctgaagcaggagaacaattctgaaaacggccggatccagctgcagattgccacgcgcaccttcggcaccctgcagcggtactgtcagaagctggggcaggagattgatgcggacgtgtccctggaactgcagaatgtgacgctggagcagattcgggatgtctccgccctggtgtacaaccagattgaggaatacatttatctggagctgctctggggggagtccattgatcagatgctccagaccggatttcagctgctgctgctggggatctggcggcggtggtgctgatggtggcggttctggcatttttgctgatgcgcatcaaccggaccatcaacgaccccatccaggcgctggtggaaaacacccggcggctggcggagggcgactttgatgccctgatggaagatgccggggagaatgaggtcaccatcctcaacaagagcttcaaccgcatggcggcaaaactccagcgcctgatggaaaaagtggaggaggacacccgcacccaggagcagctggagctgcggctgcttcaggaacagatcaatccccactttctctacaacacgctggagatcatcgtctggctggcggagtccggggataaggagcaggtcattcaggtggtccagtccctctcccggtttttccgggtggtcctcagcaaaggccgcgcagtggtgtcccttcaggaggagctgtcctgcatccaaagctatctctatattcagaaagtgcgctatgccgatatcctgaactatgagatccaggcggagcccgaagccttggactgccggatccaaaagctgagcctgcagccccttgtggaaaacgcgctgtaccacggcattgaaaagaagcgggggggcggcaccatccgcgtctgcgccgatgtgaaggacggctgcctggtggttcaggtggcggacgacggctgcggcatgacgcctgagaaattggaggaagtgcaacgggaggtggccggagatctcggtcagatctccgagggcgggtttgggctgcccaatatccaaaagcgcattcagctggcctatggagcggattacggcattcacgtgagttctcggctgggctgcgggacccgggtcacgctacagattccggcaaaatcgtaaaaaagctgagaagcagcagaaaaaagcaaaagtccggctttccggccggacttttttctgtaaaattcaaataaaaacccgttggagcgcctcttttcaaaggtggaggcgtcttgtatattatttaacacagggcgcgagaccgcccattcggaagatgaagaaagcgagaaaggattgaaaggtatgaaactgaagaaatggttgaccggcgttttggccgctgcgatggccctgtctctggccgcctgcagtgatggaggcgcggaaagcgccgatgccggcagtgaggacagcatcacccttggatttgcccaggtcggttctgagagcgagtggcgcactgccaacaccgacaacatcaaggctgccgcggaggccgccggcgtgaccctccagttctccgacgcacagcagaagcaggagaaccagatcaaggccatccgctccttcatcgcatctgacgtggatgtgatctccttctgccccatcgtggagaccggctgggatacggtcctgcaggaggccaaggacgccgggatcccggtggtcctggtggaccgcggcgtgactgcggacccctctctgtatgtgacccacatctttgccgacgccctgaaggagggtgccaatgccttcaattgggttgacgagtatatgactgctgagggcaagactccccgtgccggcggcgatcagttccaggtggcgattctggagggcacggtcggctcctccgtggccgccgaccgcctgcagggcttcaacgatgccatggccgaatcccccaacagcggcaagtacaacgtcatctgttcccagaccggtgagtacacccgtgccaagggcatggaggtcatggagtccttcctgaagtccgacggggacaagatcgatattctcttctcctgcaacggcgatatggctctgggcgctattcaggccattgaggctgccggactgaagcccggtgaggacatcgtcatcgtctccatcgacgccgccaagggcgagttcaacgctatgatcgagggcaagatgaactgcgccgtggagcacacccccaacttcggcgagaccctgatggaaaccgccaagaagattgtggccggcgaagaagtacccgccaccattgagctggaagaggggatcttccccgctgacattgccgagcaggagctgcccaaccgcacctattgaccggctttcgccaaccgttccatgatcccgcgggcgggggatgtcctccccgcccgcggactgttttgccctggctccccagggcctccggcgggatgccagacccgccgaatccaagacaaaggatgtgatgacctgtggcagaagaagccctgttgacaatgcggggaatctgtaaatacttccccggcgtccgcgcgctggagaatgtggatttcaccctgcactccggtgaagtccacgcgctggtcggcgaaaacggcgcgggaaaatccaccctgattaaggtcctgaccggcgtccacgcaaaggacggcggcaagatcgccatggagggcaggcccatttccccctccagcccgctggaggccatgaagtgcggcatttccaccgtgtatcaggaggtcaacctgtgccccaatctgagcgtggcggagaacatctttatcggccgtgagccaaaaaaggcgggcggcatcgactggaagaccatcaaccgccgggccgcggagctgctgactacgctgaatctgaacattgacgtgacaaagacgctggggagctactcggtggccgtccagcagatgattgccattgcccgtgcggtggatgtggacgcaaaggtgctgatcctggacgagcccacctcctccctggatgaggaggagacccagcgcctgttcgcagtggtccgcaagctgaaggcccagggcctgggggtcatctttgtctcccacttcctggatcagatctatgagctctgcgaccggatcacggtgctgcgcaacggtgagctggtgggcgcctatgccgtggcggagctgccccgggtggagctgatctccaagatgatcggcaaggagctgggggatattcagagcatgggcaaaaacaccgccctgtgcggggacgaggtgctgatcgaggccgacggactctccgcgttcggccgtatccaggattttgacctgcagatccacaggggcgaagtcgtgggctttgccggcctgttgggctcaggccgcacggaaacggcagagcttctggccggcgtggccaagcccgaacagggcgcactgcggatgaacggccgggaagtccatttcaactcccccctggacgccatgcaccacaagatcgccttctgcccggaggaccggaagatccagggcatcatcggggacctctccgtccgggagaacatcatcatcggccttcaggccaaaaagggcatgtggaaccacatccccctgaaggagcaggagcggatcgccgacgagtacatcaagctgctgcagatcaaggtctcctctccggagcagctgatccgcaacctctccggcggcaaccagcagaaggccatcatcgcccgctggctggtgacgcagccggatctgctgatcctggatgagcccacccgcggcatcgacatcggcaccaagacggagatccagaaaatggtgatccagctggcccgggagcagcacatgtccatcatcttcatctccagcgagattgacgagatgacccgcacctgcacacgcctggcagtcctgcgggaccggcggaaggtggcggaactgaccggcgacgacatcaactccgaccgggtgatggcagccattgcaggaggtgcctaaatgatgggaaaagtgaaaaaggtgacgtccaaccacctgtttctgccgctgtttgccctggctctgctgctggtgttcaacgcgtttgccacccccggcttttttgccattgagttccagaacggccagttttacgggcgcattattgacattctcaaccgggcttcgatcctggtgatcttgtctatgggcatgaccttcgtcatcgccaccgggggcatcgacatctcccagggttctgtcatcgccatctccggcgccatctgctgctccctgatcggcggagcaggggacggcaccgccaatatgccgctgctgccggcctgtctgatcgccgtgctggtctgcgccctgtgcggcgtgtggaacggcttcctggtctccaagctgaagatccagcccatggtggccacactgatcctgctgaccgccggacgaggcatcgccatgctgattaccaaggggcagaatgtcaccgtgtactatgagcccttcacctacatcggcaccaccattcccggcagccccctgcctaccaccatcttcattgccgccctcatggtgctgtttgtggttctgatccagaaaaagacgtctgtgggactgttcgtccaggcggtgggcatcaatgccaacgccgcccggcgcacgggcctcaaggtctcctccatcatctttatggtgtacgtcttctccggcatctgcgccggcattgccggactgatggaatcctccatgatcgcggcggcggaccccaacaacgccggcctcaacatggagatggacgccatcttgtccgtggccctgggcggaacgcttctcagcggcggcaaattctacatcggcggctccatcatcggcgccatcaccatccagacgatgaccaccacgctgtacgcgctgggcgtctcctcggagcagctgccggtatacaaggcccttgtggtcattttgatctgcctcctccagtccgaaaaattcaagggtgttctggagaagcgcacagcagaaaaggcggtgaagcagagatgaagcagaagagcagcctgaaagaccgcctggtcggttcccggtatttttccttcggcatcaccctgagcctgttcgtgctgctgtatgtggtcggcatgatgaactaccggggcttcatgaagccccaggtgttctgcaacctgctgatcgacaatgcggccctgattattgccaccatcggcatcacctttgtcctgctgatcggcgggattgacatctccatcggctctgtggtggcgctgacctgtatgtcgtcggcgcagatgctgcagaacacgggcctgcccgcgcccgccgtcatcctgatcgtgctggccatgggggctgtgttcggcctggtccagggctggctgattacggaattcaacatgcagcccttcattgtcacgctggcggggcagttcttcgcccgcggcatgacggcgatcatctcccgggagacgattgttattgacaatcccgtgtacacctcgctggcgtccgcacggatctatgtcctgcccggcggattcatctccgtgggcgtggtgatcgcgctggtgacgctggttgcggccacattggtgctgaagttcacccgattcggccggaacatctacgcgctgggcggaaatgagatgtctgcgcagctgatgggccttcccaccaaacggacgaaaatcctcgcctacgtggtgtgcggcttctgctcggcgctggccggtgtggtctactccctcatcatgctctccgggtatcccctccacgccgtcagcatggagatggacgccatcgcctcctccgtgatcggcggcacgctgatgtccggcggcgtggccttcctgccaggcacccttctcggcgtgctgatccagggtgtgatccaaaccttcatcaccttccaggggacgctctccgcctggtggacgcgcatcatcatcgccctgctgctgtgcctgttcattgtgatccaggcggtggtcagccgcagccggcagcgcctcaactctgagcactgatttttcccaatcttcttttcttcttttttccggcacagtcaccaggcacgtcctggtggctgtgtccatttcaggaggtttcggcatggacgctttactcatcaaaaccggcgggctgctgctgatcgtggcgctgggataccttctcaagagacggggcgtctttcagcagggcgatgcccgtctgctgtccaggatcatcgtcaacctgacgctgccgggggctctcctctccagcttcagcgcgttcaggctggttccgtccctgctggcggttctcgccgcggcagcagccgccaatgtcctgctgctggctgtctccgccctggtgacccgggggcggccggggcccgtccgggcgctctacctgctcaacgcccccagctacaacatcggcacctttgtcctgccctttgtgcagagctttctgccgccggacatgctgctggccgtctccatgtttgacgcgggcaacagccccttcaactgcggcggcgcctatgcactgacggccgccctcaccggcggggagcgcctgacggtccgctccgttctgggcagaatgctccgctccgtgcccttcgacacctttttggtcattctgctcctggggctgctcggcctgcgcctgccgcagccggtttacaccgtggcggggatgttcggccaggccaacgcctttctggcgatgctgatgatcggattgctgctggagccgcggattccgcaggagagccggtccgacgttctgcgggtggttctgctgcgctacggattcggcctggcggcctccgccgtctgctggatgctgccgctgcctgccgggatccggcaggtgctggcgctgagccttctggcgccggtgccctctgtctccctggcctactgtgagcggtgcggctgtgattccggcgccgtgggggcgatccactccctctgcatccccatcagcctggcctttacgctgctggtgtgcctgatgtgatgggacgacgcctattgccgtttgcccgctgcgttgtgctccgggcagggggcagctgcggcctccaggaattttcctggaggccgcggctgttgggaagatggacgcttgcgtgtctggatttatgggctgtttctgccggggcggcgtggcggccctttgcgtcctgtaaaaaattcttggctgttgtcctggagggcgtaagtctgacagggagacagctgtcccagagaggagggcgcagatttccagcttcgctcccggagggggaggaaaagaagagtcattcgtatggaggtcaacagcggccacacactctatctatgctggttcgaccttggaagtctgggcgcgaagtaaatatgccccccggctctaaagagccggggggcgcaacagttttcaggtaattctttacttggaaacggtcacggtgatatcggtggcaattgcgccgacattgttgattgtgatggtctgggtcttgtttccggtagcatcaccaattccgctagcagtgacagggaccttggaaccgtcagtgctgttagcattgaacgtgctgccgaaggtgctggtgttgtgagtcagaacgatcttaacctgacccttcgccgcaacatactcagaaccctctgcaatttccacactgatggttttagcatcaaccagagcctggacatcagcgtccagcttcaggttgacaacataaacctgggtggccgtcacggtggcgttcttcacggtgccgccattgggcttggtgtaagtccactttgcagtgccgctaacatcctcaacggagatatcggtgcagcccttgtcctgcaggatggcgatgatgtcatcctcactcagagtgatcttgccggcctcacggtagtactcgatggtggtggtggagcccagggacacatcacggacctcgatatccttgctcagctcaggcttatcgtcgccagaggacttgtcatcgacttcctcgatcaccaggaactcgaccaggtactcgtccacaacagcatagaccttgtcgttgctgtccttggcgatggcgcgataagaactggtctcaatattgccatcctcgtccacatagaagatcttggcgtcgtcggccacggtgatggtgtagttggtgtcatccttgtggttcgcagtatccagcaggaccgtgtagtcggcggagatcttgtcaatgccagcgccggtcaggtactccttgccggagtcaccctcgccatcgatgaaggacacatagccgtgatcgccgttggtagagaccttggtaatgataccatacttgtcaacggagtagttcttgtacatgccgttgaggttcttgccctggttctcgtccaccttgacggtctggacctcgccgttgacgatggcctgatactcgaagtagtcgccgtccttgtcgtggatcaggttggagacagactccttggccaggaacagggtggtgttgctgtcgtcctcgatggcagagccgtcctgaacgaagatgaacatgatggtggccatcttgccgctcttgcagtaggcataagactcaaccttggtcgtgctgccgtcgatgctgggagcgttcttgatgccggtgtagaccgtgtaatcatcgctggtgtcgttgtacaccacgaacacagtgctgctgttggtggtcacggtcttgccgctataaagtgtgacagtggccttgtcgttctccatggagaagtcggtgttgttacttgtgtaatcaccgatatcagtatcagtggggatgttctcgctggtgagagttgccttgacagccttcagggtgtagtcgccgtcctcgtccacgcgataagtgacgatggtgccgttatcaatcttatcgtcgccgttcttgtagttttcggtggtgtcaacaaccttttccgtgccgtcggcaaagaccagcagagcgcggttgttggagaagtcacccttgtcctgcgtattcatcagcagggcatagtcgccaatctcgtcaacttcctcgacatagatcaggtagccataggcgtccagatagacatcatagtcctcgtccacgctgacattgccaatgtcctcgccggcgatgttcttggaagcggtgtaacgggtgccgtcaatggtcagagccttgcgctcgtcctcgtccttggcattgttctcagcccgggtcacggtgccggagacctgctcagccagagccacggacttgacctcgtcggcagactgagagtaggtgtacaggacataggcgtcatcctcgaactcttcgacggtctcaaagtcctgaatgccgttcacaccgtcgggcttcacatcctcaacagcgatctccacataggcgtccttgttgcccttggcagccacggaacggttgatggtgcccacataggtgttcaccatagtgatcacgacggtgtcgtcgtcatcatcatagaagacctcggtcagaacgccgttggcgccgaactcggtgtcgtcgtcgttcttggtgatgtcaacagccttgtccttcagctcagcgccgtcctcatagacggtgacgtccttcttgtccacgctgctgcccaggtccaggtcggcatagatatcgtccacggcgaccttggcggtgtaagaagcgtcagcctccttggcgtaggtgccgatcttctcggccttcagacgccacacgttggcgggacgggcgaaatcatccgtgccgtcggacagcttcagatcgtcgaagtaacgctcggcgaactgcatcttgttgtcctcgctgatgctctcgttcttgtcgttgttgacaacatccttccggctggaagtggtgttgatggtgatgtcacccacaacgatggtgttctgctggtcatactccaccatggtggcctgcagcatgttgaacgcatacagggcagcctcctggcgggtcacggccttggagccaacgaactcgtcgttgccgtcgtccaggccaatgcccacggcctgcttgatgacggacacggtccagttggggccggtgtagccctcgatggagctgtcatagcccagagcgcccagcagcatcttcatgaacgcgttgccgctcagggtgccggtgggacggaaggtgccgtcagcgtagccgctgatgataccctgctgagagcagtaggtgatgtagcccgcgaaggtgttggtcacgggaacatccttgaaggggcggtgcctgcgctcagagcggaggcagtggtggggcccaggatcaggttgcagatgatcttggcggccgcaccgcgggtcaggacatcatcgggacggaagtcgccgccggaataaccgtcgacaacgcccagagcagagatcacatccacagcttccttgtaggtgatctcgctgtcgtccgtgaagtccttggcgccggcgctgacggtgaccagagacatggtcatcaccagagcaagcaccagagaaaggaacttcttcatttgggatttctcctcctttaaaatatttgcggtccgccggtatgcctgccgccgggtctgagattcgtgtgggggctagccaaccaacttgtgtcggcctacaccaaccacagagccggccgccagtgacactcccgccgtccgcaacgccaatgtatcagtgtttttccggattgtctacggattcggcgcgattgttattcaaacgaaacacgccgttcaaaagcgtctgattcgtggtaatttatgtaacaaaagttgcagatttccaaaaaagagagaggcgggaaaccggggctgcccggtctcacgcctccttctgcaagaggatgtatttctgcccgtccttggcgatctggtgctccgccagcatccgctggagaatgggccagcactggcgggggccgattcgcagcacccgggcaatgtcctggcggtaggcaaaccccgcttccgacaggtacgccaggatcgcctgctcctggtcctccggcggcaccaccgtgctgggcaggtaatagcggtttcccactttggtcagctttccccgggccaccatctgccgaagccggttgtaggccgtgttcttggagacccgcagaagggccatcacctcattccgggtgatggagccctggcgccggacaacgtccagcacctggttctcgccgcccacccggatgtcgtagtccaggcgcaggtcccgcagggagagatcgtccagcccgccctgcaccagcgccgcccgcaccagcttggacaggcgggtgcgctcataggggcggcggctgcggggggacatcaggacccactccgcctctggcggcgccgccttgcgcagcttctggagaatggacaggacgccgctggtcaggcggacttgccggtccggcaggataagccgctccttctgcaggtccacctggtcccaccgcagcgacgcgatctcctccacctggagccccagctgccaggtgagccacagggccgccccggcgggggtgtcctgttccgcctgcagcagcttccagagggcgaactcgtcgatctgcggcgctgccttccggcggatgcgggtggagaccttcttctccgtcaggtaggccgcgaagtggacgttcatggcggcggcctccagcccggtgatccgggagacgtactgccagtcgtgacgttccagctgccgcagaacgtagtcgtggcgcaggtcgatcaggcggacggccttcaggtccccggcgtccagcgcggcgcgggccaggcgggagatggactgggccgccaggggctgctggtcccggtccgacagcaccacccgttcgctgctgccgttccgctcccggcgcagggcctccagccaggcggccagctccggggccagcgggaccgcccggtccggcagcaggagctgttcgcccagcagatccacctgagcccaggtgaggtgctggatttcgtcccgcatcagaccggccatccacgccagccgcaggatggctcccgcggcatcatttgtatgctgttccagcacccggcaaagcaaggctccatcggggcggttgagcgtgtaactctgcatggcgtctcctcgttttgttacgcttgtgtgtcacaaaaatgaccttcctgcttttggaagcctgcgggtgacggaatcttctctataagctaacgttttttgtgacaattgttatgcacgtgaaaccgcttttgaaaaaactcctaatccattgcaccacaatggatacggagattttctcactcaaaatatacactataagataactaaaatcaatatcttatagcatattttgaatggacacgttccagaatagacttattctaaaaggagcgtgaaacagatgacaaaacaggagcgagtcgccatggggcaccggctgcggcagcagaggacccttctgggcctcacccgggaggagtttgccgagctggcggatatcagcgccggctattacggccagatcgaggtggggacctcgcagatgtccattgacacgctgattaaattatcgaagacgtcgcagctctcaatggagtatatccttttgggagaggagattcagcccgatgcagatctgaccgccatagaggccctgctggcccggtgcacgccccgggaggtccggctggctgagaaggtcctccggctgtttctgctgcggggagacgcatagcgggcctgcggcggccggatagatctgcgcccgctgggttgaaaaaccggatccacttcttgattcggcggccgccatccactaaaatagggaggtaaacccgcagggcggagaaacggatatgcgagaaaggacgggatcccatggaactgcagaagggacagaagtgcaaactggcggacctgaccggaagcggacagctgcgaatctccgtgacggtgtccctgccggggagcgaggcggacgtgacctgcttcggcgtggacggagcggggaagttgtccgacgaccgttattttattttttacaaccagaccagttcgccggagggcgccgtctccatgcaccagtccggggagtccacggtattctcggtggacctgaaccgccttccgggcttcctgcagaggctggtggtgacggtggcggcggagagcggcaccatgcaggcgctggcccggggactcctgacgctggaaggagagttggaccgggcggcctatgtcttcaccggtgcggggtatcaacaggagaaggccctgattctctgcgaggtgtaccgcaaggatgggatttggcgcttttccgtggtggacagcggcttcaacgggggactctccgccctgctggcccacttcggcggggaggaggtcaagcctgacccgccgaccccggcacccgctccgccggagccgaaggtgaatctctccaaaatcagcctgaagaagagcggagagagccacaagatcgacctgacgaaaaaccgtcggcgcatccacgtgaacctgaactgggaccagcggcggggcctgttcagccggggcatcgacctggatctggcctgtatgtaccggctgaaggacgggcggcagggggtcatccaggccctgggcaacagcttcggtgccgccgatcagcccccctacatcaagctggacaaggacgaccgctccggcgccagcgccaacggcgaaaacatggacttcttccggccggagctgatcgacttcgccgtggttttcgccttcatctatgagggcgtgcccaactggcggtccaccaacgcccgggtggtgttgagccagcagggggcgccggatattgaggtccagatcgacaaccccaacagcaacgaacggttctgcgtcctggccagcctcaccggccgggacggcgggctggaggtccggcgggaggacttgtttttcaacagccaccgggctgtggacgcccattaccacttcggcttccgctgggtggcgggccacaaataacacgggagaggagccgaagtcatgttggatttgcagcggggacagaagatctccattcaaaccgtctgccggacctggaccctggaggtggagctgcggcatcaggggcccctggcggtcgacgtgtcctgctttggcctggacagcgcaggccgcctctccgacgagcggtattttcttttctataaccagcggcgctcgccggaaggggccatggccctctctgagggagcatccggcggaacggcccgattccaggtggatctggcggccctgccggaccatatccagcggctctccttcactgccgccattgacggcggccgcaccctgcgggagctggaacagggcagcatcggtctgtgggtcagaggggaggagatggcccggtatgcctacgcggggaacgagttctccggggagcgagccatcgtggccggcgagctctaccggaaaaacggggactggaagttcagcgccgtgggccggggcttcaacggcggcctccgggccctggtggagagcttcggcggcgtggtgtcagacccggtcccgccgcctccgccgcctgtccggacagctgtgtctgcccggacaacccggcagccggccgcgcccgccggcggtccgcctccttccgtgggggacatcctgcgctccctgccgccccatgtctgcacccgcatggaggggctggcccgccgctgccaaggggacctggacttcctggcgccgttgtacaaagcctcctttgcagcactggcccaggtgccccgggcagcggagagggaccttcagacggtcctgtgcgccgatgcctccggctccatgttcgacctgtaccgcgggggccgggtccagcagatgttcgacaagttcttcgccctgtcctccaccctgtcagacagcggcgccctggactgctgggcctttgctgcgaagagccgccagctggagccggtgacgctggataacatccgggactacaccttctctcaggccggcggatacgagcggtggatgagcatgctcaactaccagtacaacaacgagccggaggccatgcgggacatcatgatgatctacggcggcctgcgcaggcccattctggtgctgttcctgacggatggccggttgcagtccgactgggagatcgaggagatcctcatcaagacctcccgtttccccgtgttctggcagttcatcggcctctatggcgaagagtacggcgtgctgaatcacctggatgagatcgacggccgccacacccagaacgccgcctttttgaagatggaggatttcgacgatttcatggacagcggcttttaccggaccattttcgcaaacacggccgcttggctggaggagctggaccggaagcagatgctgccgtagaggagatgcgctggggcggatgctatttacggggcagcagggggcgggagccgaggcatgggactttttcgggtgtcaaatgatgcggagactgtgaaaagcccctgggatggaacccggcgcatcagggattttgccgctgggcattgcgcactccagctgatgcggccctgcgggatacccctggttgcccggagcggcaggccgtgaggctgcgggatggctgtgccttcggatgcggcacgtctccatgcttctgtcaggggccatcccggcgctctcgggtttgcgttacccccttgcccggacaggaaaaagaaggtataatcattttgttccatcacagcgggcggacagcccgcggcaaggagaaactgaggaggtcttcttatgctgtgcacgagagaagtcacggtccaggtccctgacggcctgcaccatcagacggcggcccggttcatccagactgccaaccgctttaccagcgttgtccgcgtcgtatacggcgacaacaacgtcaatgccaaaagcctgctgggtgtgctctccctgtccatcggagcggggacgcggatcacgatcaccgcagacggagcggatgccggagaggcgctggatgcgctggagcagtgccttgccggggcgtgagcctttggagcagacctgatctcctgaatcaaagaggggccgccggcaaagccggcggcccctctttacagaaatgcgcggggaccggacaggcatccggtccccgcgcactctgagattgatcgtctgacaagcgtcagtctgccgtctcctcccggccgaccttcacgcccatcttgtcctcgtaatacttgaccagtgccgcctggtcctcgtcgatgtggccgttgtcgttcatccagtccatcacatggaggaccacatctgtcagcggcgtgtcgatgtccagcttgtgggcatagtgcttggcgttcaggatgtccttccggtggacggcgatccgcgcgccgggggtgtagtcccgcttaatgatcttgggcaccttgttgtcgtacatgggaccgccggcaaagccgccccgggtggcctcgaacgtggtctgcaggtcgatgcccgccttggccgcgaaggcatagccctccgcaatggccaccaggatggcgccgccgatcatgttgttcaccagcttggtgacgctgccgctggcggggccgccggtgtaaacgggactgcccatgcacgccaggaccggctttaccttgtcaaaggcctctttgtcgccgccggtcataatggccagcgtcccggcgatggccatggggttgccgccgctgaccggggagtccagcaggaacatccccgcgtccttggcctgctggtacagctccagaatgatgtccggtgcggtggagctcaggtccacaatcacattgccgggcttaccgtactggatggcctgctccacgctgttgcggatgatgggatgggtgggcaggatctggaggatcacgtcgcaggccttgtagatttctgccgggtcactgacggggatgccgcctgcctcccggaaggcgtccatctgctgctggaccacatcgtagcccagcacgggcagcccgcacttctgcaccacgtttttcgccataggcagtcccatgacgcccattcccaaaaatccgattttttgcatatccaagacttcctttcttcgcaatcagcccgccatgatgctgggaagcaaggtggtgaggggcgagacataggtgatgaggaacaacacgataatggagatcagcagcatgggcatcatggccttcagggagtgagacagccgggtttcgccggtctggttgcacagcagcagacacaggcccaccggcggcgtcaccagaccgatgcagaggttgaagctcatgacgatgccgaactgcagcagatcgatgccgaaggcattcaacagcggcagcaggatcggggtcatcatcaccacagccgcattggcctccatcagcataccgatgatcaggaacagaatgttcagcagcagcagaatgacgacggggctgtttgtgatggagctgaagaaggagaccagctgctggggcaggccggaggtggtgattacatagctggaggcggaggacaggcccaccatcaccatgatggtggcggtggaaactgcgccctccacaaacacctggggcagctccttgaagctcatgtccttgtatacgaagaggctgatgatcaggctgtacaccactgccacggcagaggcctcggtgggggtgaagatgccgccgaagatgccgcccaggatgatgatgggcatcagcagcgcccagatgcccttgcgcacggaggagccgatcttcctcaggttgggcttctcatgggccggcagattgtgcttgtggccgtaatacaggccgtaggcaatcagagccaccgccagaatgatgcccggcaacacggagcccaggaacagctccgccacggacacattggtgatgctggcgtacacgatcagcacaatggagggcggaatgatgggacccaggatggaggagatggacgctacgcccacggcgaagggggcgggatagccctcccgcttcatggcggggatggtgatgccgccgatggcggaggcggtggccacgccggagccggagatagcgccgaacagggcggaggccagaatggtcaccagggacaggctgcccttgatgtgtcctataatggcattacaaatgtcaatcagttttcctgtaatactgcgggacatgatattgcccgccagaatgaagaaggggatggccagcagggcgctgccgttcatgcccgcgaacattctctgaggcagcacaatcaggggcaggtccgccaggttcagggccgccagggcgccgatgcccagggcgatgtagatggggaatcccaggagggcgagacccagcagcagaatgatgattaacaggccggcgttcatacctgggcctcctttccggccccgcgcagggcagagatgttcttgaagaggacctcaatggaagtcaggagcatcagcacgatgccgacgggcatacaggaataggggatggacatggggatcccaagccccgcagacatggtgcgggcgccggtctgcaccagggtgatggagtaggacagcaggaataccatgaacaccatgccggccagagtggcgatgatggtgaggatggtccgcaccttcggcttcatcagattgatgagaatgtcgatctgcagatggctgttgcggcggatggcaatggctgcaccgatcatcacgtcgtaaatgaacagataccgggccagctcctcgctccaggagttggcgtgggcaaagatgtaccgcatgatgacctggtaggcgatgatgatgaccataatccctacggtgacagccaggatcgctttctcgaccttctccaggacatctaggaatttggaatatcctctcagcatgtttgacacctcgctatgtccttcgtggcggttgtcaggcattgggagccagtgcacggatctggttgcaccagtcggccagatcggggaagttggcctccgcatagccgctgaaatgctcggtaaaggcggcgttgtccacatccacaaaggtgacgccttccgcggtcagctcttccttggcggcatcctcccgctccagcacctcctgaccgatctgctcgccggcatagacggcagcctcctccagcgcggactggatgtcctccggcagggattcaaagtacgccttatccatgataatggtgttggcgctgtatacatggttggtcagaatccagtaggggcagacctcctggaaggaatagctctgggagtccaggatggagttctcctgcccatccacggtgccctgctgcaaagccgtgtaggtctcgcccatagccaggggagtcggggcggagcccatccactcccaaaccttgatgtagccctccagattggggctgcggagcttgaagccggcgaagtcctccacggtcttcatctccttggtggcggtcacgatccgggcaccacggtaaccggcgcccatcagcttgaagccggagtcattgcccacggtgtctagaatctcctggcccagctcgccgccccagaccgcctggaagtggtcgtaaccgttgtagatgtacggcatgatgtcgatatttgccagatttgtgaagggagccagtgtgcccacggactcgcaggtgatgtccgctacgccggcagccatgccctccagcacctcagtggtggaacccaggctgttgccgccgtagaattcaatggagacgcggccggatgtgagctcctctaccttctccttgaagaacgtggccatatcatagcccagctcgccgggggcactgccgttcagcgccatgcgccaggtgtattccgcgccggtgccgtctccgccggaatcaccgcctccaccgccgcagcctgtcagcagggtaaacatcatcacaagtgccaataccattgccaacgtctttttcacatcaaacactcctttttcttttatcctgtcgattctctgcgaagggtcgcttgctgccgggacatgacagttgtgccgccggcctgacaacaaaatatgttgccttataaatgattttaccatttatatttcttgctttattttatagcactttacccaatgctcgtcaagcgttattaaaataacgagctattttgcacaatttttaacaatgtcgcgtgcggatatgtctcgccactcctgcaggcatcctacggactctcccttgattccggctttcgagtatgatatacttttcacaaaaagcaggaagggtaaggagaaccatgatggagcagccttcttccaaagccctcttcacgcctgccaagacccagcgggcgtccgaggctatttacaatcagatctaccccaagatcatttccggggaactgcgtccgggggaccggctcccgccggagcgggagctggcggagatgttccagcgcagccgccctgtggtgcgggaagcgctgcggatgctccagcaggagggactgatcgaaaccgccgtgggcagctccggcggcgcggtgatccggggcgtctccctgaaatccgtggaagagcccctgaaaaacctggtggccatgggggccatcaatctggatgagctgctggagtatcggcatatcaacgaccgcagctgcgcccgtctggctgccatccaccacacggaggaggatgctgaggcgctccggcagaccctggagggcgcgaaggccaacctggacagcctcttcagcttccaggagtatgatgtggcgttccacagcgctttggccaaggccagccacaacacgctggcctctctgattaatgacgtgattgtccgcctcaacacggatgtgtttgtggagacgattcgggattacacaccggagcagctgcgggagatcaatttgcggatctacaacacccattacgccatcatggaagccgtcctcgcccatgaccccgacggggcggaccgcgccgtggcggccatggtccggctgtttcaggatacggtccattgaacaggcacggagcttcacaagtacggcagcgcaccgcgaaaagaaacgctcgccgctgcgcatgagggggcgcattcggatcctgctgcctgggaagggcagggaaataccgttcacaaatttctgcgatgcagctgcgtcgcaaaaaagctggctgcccgtcgggcagccagcttttttgccatgatgttttggaaaggagttcccgcggttaggtgccgccccgcagggtgttctcctggatgaagcggatcagctcccaccccagcttgggcagatagcgcccctttttgagaaagaaccccacgtcgaacaccaccggctcctcgaaggggcggatcgccagcccttcgcagcccagggcctgctggccctgggccacgctgatgatgcccacgtaccggcaggagcggaccagattcgccatgcacagcacctggtcatagttgaagagaatgtccgggatcacctgatggcgctcaaactcccggctcatcaactccttcaccttggattgggcgtccatcataatgagcttctcctcccccagccgcgccaggggatccggtccagccgcgccaggggatggtccggatgcagcaccgcgtggatctccatagtgcccataggaatgatctccagctcctccgcctccggcgctgtggggaaggcgttataagccaggtccagcatttcacccgtcaccatctccacgtgcttgttcatggagccctcgttcaggtagatctgcgccttggggtgctcccgcagaaaggtggagaagatcatgggcacgatgggattcgtcagcacgtgggagattcccagccgcaggcgctgttccgccgtgccggccagatcccgcatggcattttccgccgcttcacaggtgctgaggatgcgccgcgcccagatcataaactgctcgccctcgtatgtaaaggtaacgcccttggagctgcggaccaccagccgcacccccagctcctcctccagcgcctggacggcggaggagatggccggctgggacacgtagagcgcctcgctggcctgggtgaaattcttatactggtagaccgcgtccagatattgcagccgcttcagattcagcatccggcagacctcccatccctccggcggcgcaccgccgcgcttttctttaagaataaaggagttttattgaaaaatcaagattttctttatgccaaaagtgcgaattgacatttttttgactagctgtttataagtttttgttattcctgcataaaaacatggtatttcactattgaattgccagttgctaaaattcaaattggaagacatattggggggcgcgggaaaggagggtacacggcaacgggcgccgctttcatcaaatctgacagagaaggacgggaggatatagacaacatgatcgtagtgagcgtgattggaatcattctggcattcgcggtgctgatctttgcggcttacaaaaaaatcagcatgttcctggcggcagtgctggctgcggccatcgtggccctgttcggcgggctggacgtggcggcctccctggtgggggcggacggccccttcctcatcggcatgaaggacttcgtgggcagctggctggtgatcttcgccctgggcgccctgctgggcgcgctgtatgacaagagcggcgccacctggcgcatcagcagcaccctcatcaacaaggccggaacccagtggacgctgctgatctacgtgctggtaggcgccttgttggtgtacggcggcatccaggtgaccgtgatgatcttcgtgctgctgccctttgccaagatcctgttccccaaggcgggcatcccatggtacttgttccccggcatcaccggcctggccatcgccacctttgccatgggccagatgcccggcagcctgcagatgcagaacatcattcccactcagattctgggcacggcgctgaccgccgccccggtggagggcgtgctggccacgctgttcatgatcgtcgtaggtgtcggctacctctactggcaggtgaagaagggtcataacgacccggaggcggccatcgagctctaccaggtccagggcggcattttggacgagaaagagctggagcagcgggctccgggcttctggatctccctgctgcccatggtggtgaccttcgtcctcatcaacggcttcggtgtggagctgctgtacggcctcacggccgggtgcgtgctgtccctcctgttcttctgcaaatccctgggcggcgtcaagggctttggagaaattgtctccgagggcttcaacaacgggatcttcccctgcatcatcatcgctgccgtggtgggcgtgggcaaggtggtctccgccaccgatgtgttcgccctggtgcaggagaacatcatcaacctgccgctgccgggcctggtgaaggtggcggccatcaccaccatcatcgccggaatcaccggctccgcctccggcggcctgactatcgcgctggagctcttcggtgagaccttcatctcctggggttacacgccggagatcatccaccgggtggcctccatcgcctgcggcggactggacaccctgccttggaacggcaccgtagtgatgctgttcgccctgtccggcgtgtcctataagaagggctacaagcacgtggcgatggagacggtcattctgccgctgctgtccctgatccctgtatttatctactattccatcgtacactgagaaaggtcgtgttgaatcgtggctacctatgaaaagagctttttgttgtccctgtaccgggacatggtccggatccgggcctttgaggaacacgccgccgagtgcttcaccaagggcatgctggcgggcaacatccacctgagcatcggtcaggaggcagcggaggccggtgccttcgcggccatcgagcccagggactacttcacctccacccaccggggccatggccatgccatcgcccgcggagcggaccccaagcgggccatggcggagctgttcggcaaggctgccggctactgcaagggcaagggcggctccatgcacattgcggacatggagaagatgaaccacctgggcgccaacggcatcgtgggcgccgggcagcccatctccgccggcagcgccctggcctccaagatcatgggggacgactccgtcaccgtgggctgcttcggcgatggctccaccaacgagggctccttccacgagtccctgaacatggccgccgcctggaagctgccgctggtctggttcattgaaaacaactgctacggcgtgtccacggagatccaccgggtcaccaacaccccggatctggcctcccgggccgcggcctacggcgtgccctacgccgtggtggacggcacggacgccatcgcggtgtatgaggctatgaaggtcgccctggaccacgcccgcagcggcaagggaccctatgtggtggaggccaaggtataccgctatcagggccactactgcggtgacccggcggtttaccgccccaaggagtacatggagcacgccctggcaaacgacggcatcgagaagctggggcggcggctgctggagagcggcgccgcccaggaggagctggacgccatccggcaggacgcagaggccgagatggacgaggctgtgaagttcgcggatgcgtccccatatccggaccccgcgacggtgctggatgatatgtatgtgactgacaacgaaaggtgcgtggcgagatgagcaagaagatcaccgtcagcaaggccatcggtgaagccttgcacgaggaaatgctccgggacgaaaaggttttcatcatgggcgaggacatggccgtcatgggcaatgtgttcgccatcaccaagggctttctggaggagttcggccccaaccgcgtcattgacactcccatctccgaggaggggtttgtgggcatggccgtgggcgccgcgatgcgggggctgcggcccgtggtggagctgatgtacgatgacttcgccacggagtgcgcggatcccctgttcaaccaggctgccaagatccgctacatgaccggcggacagtgcagcgtccccatggtcctgcgggcgcccatgggcgccggccgccggaacgcaggccagcattcccagtgcttggagaatttcttctgccacttcccgggactgaaggtggtggccccctgcaccgctgccgacgccaagggcctgctgaagtccgctatccgggacgacgacccggtagtgttcctggaacacaagctgctgtacgcccacaaggaggagatccccgatggggagtacaccatccccctgggtgcggcggacgtgaagcgggcgggcagggacctgaccatcatcacctggagccgtgaggtctacttcgccctggaggccgcccagaccctggaggcggagggcatcgacgtggaggtcctggatctgcggactctggtgcccctggactgggatgccatcgtgaagtccgtctccaagacccacaacgtcatcatcgtctccgaggaggtcaagcggggcagctacgccggtgagctctctgcccagatcgcagaggagctgtttgatgagctggacgccccggtggaacgggtctgcggcctgaacatctgctcccccttcagcccggtgctggaggacaagaacttcccccatccggaggatatcgtgcgggctgtcaagcgcgtgctgaacaagtgaggaggcgtgtgagatggcttatgaagtactgatgccccagctgggcctgaccatggaggagggaaccgtctcccagtggatcaagcacgagggagacgctgtaaaggccggggacgtggtggtggagatcaccactgataagctcaccaatgagatcaccagcgagcaggacggcgtcctgctgaagatcgtggcccaggagggcgaggatgtgccggtgaagggactgctggcctacatcggccagcccggcgaacaggtgggggagactactgcccccgctgtatccgcggcttctgctgccccgtctgcggagcctgcggctgcgctggcttctgcccctgcggcatccccggcggccgggggcaagcggatccgaatctctcccctggcccggaagatcgccggacagatgggcgtggactacaccgtcctcaccggcaccggccccagtggccggatcgtcaagcgggacatcctggccgcggcggaggccgcgcccaaggcagctgctcccgcccctgctgatcggaagatcgccgcgcctgcggctgtctccgccaccgccttcccggtgaagaatctggagctgatggagggtgacacggtggagaagctcaccggcatgaggaaggtggtggcccagcggatgtacacctctgctgtggagatccccaccgtcacccagacggtgaaggtggacgtcaccgccctgctggccttccgcaaaaagctgaaggaggagggccatgccttctctgtcaatgactttgtgctgaaggccgtggccaaggccctgcgccgtcatccggagatcctggtgagcttggacggggagcagatcatccgccgggcccatgtgaatctgggcatggcggtggctctggacgcggggctcatcgtccctgtgatccgggacgcggacctgctgagcctggaagccctgtccgccaaggccaaggatttggcggagcgggcccgtgccaaccagctgggcgctgacgagtacaagggctccaccttcactgtgtccaatctgggcatgttcggcgtggagagcttcacccccatcatcaaccagccggacgcggccattctgggcgtcaactgcacggaggatgagctggtgatggaggacgacggcaccatcgccaagcatcaggtgctgcggatctccctgaccttcgaccaccgactgctggacggcgcggtggcggccaaattcgagatgacagtccgggatctgctggagcatcccatggacatcctgctgtgaggagcgtaaacaatggcaacggaaatcaaaatgccccagctggggctgaccatggaggagggcaccgtggagcggtggctgaaggcggagggcgatcccgtcaaggccggtgagcccctgctggagattaccaccgacaagctgaccaacgaggtggcggcggaaaccgacggcgtcctgctgaagatcgtggcccaggagggcgccgacgtgccggtaaagggcctgctgggctacatcggccggcccggcgagcaggtgggggcccccaccgcagccgcggcacctgccgccccggctgtggaggccgcggctgcccccaacgggcctgggacggtgctggtcatcggcggcggccccggcggctatgtggccgccatccgggcggcccagctgggcgccagggtgaccctggtggagcgggagcacctgggcggcacctgcctgaacattggctgcatccctaccaagtgcctgctgcacagcgcagagctggtgtcccagatcaaggaccagggcgcggagatcggcgtggaggcggacggcgtccgggtgaacttcccccaggtgatcgcccacaagaacgccgtctccaaacagctgaccagtggcgtagcgggactgctgaaggccaacaaggtggtgaagatcgacggcgaggccagcttcaccggccccaagaccctctctgtgaagaagtccgacggctccgtggaggagatgaccgccgacgccatcatcgtggccaccggctccgtcaacgcccagccgcccatccccggtctgaaggagaatcccaactgcatcgactccaccggcgccctgagcttggaacagttgcccaagagcatggtggtcatcggtggcggcgtcatcggcctggagctggcctgcgcctacgcggccttcggcaccaagatcaccgtggtggaggcgctggaccacatgctgcctatgctggacggcgacctgaccaagatcggcgtggcccacatgaagaagatgggcatggcgttcaacctggagtgcccggtgcaggccgtggaggcctctcccgtgggcgccaaggtcacttgccggaacaaggctggcgagactgtcagctttgaggcggagaaggtcctggtggccatcggccggaaggccaacaccgccagcctgaacctggaggctgccggccttgccaacgaccggggccggatcatcgtcaacgacaagatggagaccagcgtgcccggcgtgtacgccatcggcgactgtgtcaagggctatgcccagctggcccacaccgccagcgccatgggcgaggtggctgcggagaatatctgcggcatggaggcccactacgacgaatccaccaatcccacctgcgtgtacatcgagccggaggctgcctctgtgggtctcacagaggagcaggccaaggcgcaggggatcgactacatggtgggcaagttccccatgagcgccaacggcaaggctctgatcctgaacgggggcgagggcctggtgaagatcatcgccgggagggaatacggcgaggtgctgggtatgcacatcattgggccccgcgccacggatctgatctgcgaaggggcgcttgccatcggcagcgagctgacgctggatgagctggcagccaccatccattcccaccccaccgtcaccgagaccatgcgggagtgtgcgctggacgcactgggccgcgcggtccacatcccgccccgcaggaaataacagggcagtcctttccggaatttagaacaggaggtcaatgggcatgaaaacacttggatatctgggccttggcgtgatgggctacggcatgacaggcaatctgatcgacaagagcggctgcgacatctatggctacgaccccgtgcccgctttgcgggagcggtttgccgcccggggcggtaaggtcctggacgacgctaaaacgctgtacaaaacctgcgacatcatcttcatgtgcctgcccaccaacgccatcgtgaaggccaccatcacggagatcatggagactgcccggcccggcaccaccattgtggacatgggctccacctctccctatgtgattcaggagctccacgccgcggcggtggagaagggcttctatctgctggactccccggtcagcggcggcgagaccggcgccaacggcggcaccctggtcatcatgtgcggcggcgagaaagaggtctttgacgaggtccggccctacctgctgatgatgggtaagaccgccacctacatggggccctccggctgcggcagcaccgccaaggtggccaacaacatgatggtgggcatccatctgtgcgccatgggagaggcattcgcctttgcgaaaaaggccgggctggatcctcagaccctttttgacgccatcaagggcggctttgcccagagcgcagtgatggacggaaaggtccccaagctcctgagccgagacttctccgccagtgcccggatcgccgtccacctgaaggacatcaacaacgccatggacgtggccgcccacctgggggtggagctgcccatgacggagatcgtcaaggagcagatggactggatggacgcccgcggcatgatcgacgaggaccagtgcgcactggccaaatactacgaggacgccatgggcgtggaaatcaagtgatctcccgccaaggaacaggcaatctgcggggaccggcatcagccggtccccgctggttttccctgtggtacagaatcatcggattttttgcgggatagctgcgggaaatcttgcaaagcggcacaaaatatggtacattgttcgagaatacacacggcgggagactcctcccgtccgtttttcgcggtctgaccgccccggattccgcatgcagctgtgcgccgtgggtcgaagatggcccatactctgatatttttctggaggatattccatgtctgaactacgcactgaaatttcccggcggaggaccctcgccatcatcgtcccacaaaagctggcgcttttgcgggagccctgatttgcgtttgctccgggcggagtgaatccgcccttcgccaaggttttgccttggcaaaacgcttggacggcgcaaaagcgccgtgggtcgaagatggcccatactctgatatttttctggaggatattccatgtctgaactacgcactgaaatttcccggcggaggaccttcgccatcatctcccatccggacgccggcaagaccacgctgacagagaagttcctgctgtacggcggggccatcgcccaggcgggcgaggttaagggaaagcgggcccgcgccgccacctctgactggatggagatcgagaagcagcggggcatctccgtcacgtcctccgtgctgcagttccagcacagcggcttctgcatcaacatcctggacacccctggccaccaggatttctccgaggacacctaccggaccctgatggccgcggactccgccgtcatggtcattgacggcgccaagggtgtggagccccagacccggaagctgtttagggtctgcgccatccgccacatccccatcttcaccttcatcaacaagatggaccgggagaccaaagaccccctggaactgtgcgaggaggtggagcgggagctgggcatcgacacctatgccgtcaactggcccatcggctccggcaaggagttccagggcgtctacgaccgggagaagcagcgcatcctgttcttccaggcggaggagcggggcaagaaggtcggctccgccgaggtggccctggacgacccggcgctggaggacatgatcggcgcacaaaaggccgccgccctccgggaggaggtggagctgctgggggccggacgggagtttgacatggaggctgtgcggaacggcaccctgtcccctgtgttcttcggctccgccctcaccaccttcggcgtggagccgttcctggaggagttcctccgcatgaccacgccgcccctgccccgtgtcagcgaccagggggaggtggatgtgttcagcgaggacttctccgccttcgtgttcaagatccaggccaatatgaacaaggcccaccgggaccggctggccttcatgcgcatctgctccggcaagtttgagcgggacacggagtattttcatgtccagggcaacaaaaagctgcgcctctcacagccccagcagatgatggccgcggagcgggagatcatcgacgaggcctacgccggggacatcatcggtgtgtttgaccccggcatcttctccatcggcgacacggtgacggtgcctggaaagaaattcaagttctccggcatccccaccttcgagccggagcacttcatgcgggtgtctcccaaggacaccatgaagcgcaagcagttcatcaagggcacggagcagatcgcccaggagggcgccatccagattttcaagctgcccggcgccggcctggaggaggtcatcgtgggcgtcgtgggcaccctgcagttcgacgtgttccagtaccggatgaggagcgagtacggcgtagagctctacatggagggactgccctacgagcacctgcgggtcatcaccgcctgcccctgcaagccggaggatctggtgctgtgcaccggcgccgccctgctggaggacttcaagggccgcctgctggtggcattcggcggggagtggtccgtgggctttctcaccaagcacaaccccggcctggagctggccgagtccctgtctgtctgagcctgaaaccgtccgccggaaagaggcggacggttttttgcttttctttcttccggctgtcaccttttcggcggaaaccgcatcctaataagtgaccggtcaaacgaacccaaaggagcgctcagtcccgccatgacaaattttttgttggacaaagaaatattctgcgaccaggtaatccgaaaccaggagaccatgttccgcactgccaaggctatccttcaccaggacgaagatgcggaggacgccgtgcaggaggccatctgcgccgcctatgccggccgcggcagcctgcgggacccggcgcggttccgaccctggatcctgaaaattctggtcaacaagtgctatgagttctgccggaagcggaggaccacggtggacctggcggatatccaggacttcctgccggctccggcggcagaccaggcggagcgcctgtctctatggcaggcggtcatggcgctgaacagcgacctgcgggcggtcgtgaccctgttttattatgaggacctctccatccgggagatcagcgccgttctgggcatcagcgaggcggcggtgaagacccgtctctcccgagggcggtcccggctaaaacaactattacacgaggaatgaggtgcgcaaggtggagccattcgacaagcgactgaaagagcgggcgaagcaggaacccttccccctgccggagacgtatgccggaaaggtgcgggacacctgcgccgctttaaaggagacgaacatgaaagaaaacaagcaaaaacgttcctatcgctggctggtcggcgtagccgcggccctggccgtattcgtggccattcccaatgtatctcccgcggcggctgccgccatggaagaaatcccggtgctgggcgccgtggtgcgggtcatcaccttccgggattaccagtatgacgatggtcacagcactgccgacgtccacgtcccggagctgggcggtagcggcgctgcagacgagatcaacgaccaggtgcaggcctataccgatcagctgatcgcccagttccagacggactgcgaggctgcgggcgagagctaccagggcctggatgtgacctcctctgtggtgacggacagcgatacttggttcactctgcggatcgatgccacgaggaccgaggccagcggctacaatttcacccgattctaccacatcaacaaagctacgggtgaagccgtcaccctcagcgatctgttccggcctgatgcggactacgtctctgtcctgtccgcggaagtcctgcggcagatggaggagcagatggccgcggacgtatccctgagctatctgacggacgaattcaccgctattgacccggagcagagcttttactggaacgccgacggcgatctggttctggtgttcgacgagtacgcggtggctgcaggctacatgggcatggtggagttcaccatccctcaggatgtgtacagcgccctgctgaagtgaccgcgctcccccataaacctttatacgcattgggcgcatcgtagataagggcaaatgctgtggtgaaaggtttggcgcatcgtttccagttgccccaaaggagcggggaaagatgcattcagttttctgcggtgcttttatataacagagaacagcggaccgcttcagcggtccgctgttgttttcccggtttactgggcttgctccatccgccagacgatggcggagatctggccccgggtcagagtgttgtagggcttgaaggtgctggtgccgttgctgaagtagccctccacgatgcctgcggcattcagcgcctggacataggggtccgtggtgtcggtgaagggacggacgctggacaggttgctgatgctgaggcccatggccttggccgcgatctggctgaccgccagccgggtgatgggggcgttcaggttcacgctgccggacaccagcccgtccgcctgcgcccgggccagatagccgctgaacacgttggagttcaccggcttctgctcgtcatagccagcggccagcatgatgagcttcagcgccgcgccgtaggtcacctggttgtcgggcttgaaggtgccgtcgctgtatccgtcgatcacgtcggcgtcgctgagctccagtacatatttatagcaccaggtggaggaggtgatatcagagaagtcctccatagcgctgacaatgcccaggcaaagcttgccgctggcaatgggatcgccgctgctgttgcaggccacataggggatttccacagatccggtgaagccgctggccggcacgaaccgcagctggctgatccgctcgctgccgctggagtagccgtacagggtctcggtgtccgcccgcttggaggtgccgctgcccacgtagatgacaccctcgttggtggcgggcagttccagcagctggatgctggccagacccaggccgctggactgggccaccgccgtgtagatggaggcggcggggaaggtgacggccgtgtttctgggcgtggggccgtaaacgtcgggcacctcgctgaggttcacgctgatgaggatggtgccggacacagaacggctgccggagccgtaagcggtgaaggggatctgggcgcagtagttgacgccgctgggtatgtatgtcagctcgctgagggcgtgctggctgctggagggactgaagtagaaatctatgtcgtcgcagttgtcgtcggtgatgcgcaggctgctggagctgccgtagctgctggtaccgtagtagttgtagtacaggctgccgtaagtgggcgcatctttaaaggtgacatactgcagggtatagccggggtagctctcctcaaagaaccgggcgatgtcgttggcgttgatctgcactcggccgctgtaatccgtataatagcggatatcgccgccctctgcggccacgccggttccccccacatcgccgatggcgatggccacggtgccgtaggccttgtcgccgtcctcaccgtaggcagtgaagtccagctccaccaccttgccgtcggcgtccctgtccgccacaaaggtcaggtcatccagggtgaagtcctcgtcgtagaacaggtccttgctgtcatagtagaaataaccgtcgtccaggtcgctctcgtcaaagtacgtccggtcatcatcgtagtcgtagctgtacagctcgccccagtcgtccagtccgtcggcgtcggtgaaccgtacatactccagatcgtccccggtctcgtcatccaggaaatcccagaagtcgtcccggtcaaaggtcacgctgtcgtcgggatccacctcgtaaatgatgtcgcccttcaccttggtgccggtgctgctgcccttgccgatctcaatggtgagggtagcggagatcttgtcgcctttcacgccgcgcatggtgacgtcaaaggtcagggtgtcttcatcggcattccggtccgccgcaaaggtcagcgtgtccagctcgaagtcatagtcgtcccagatatcgtcctcatcatagtaaaacacggcgtcgtccaggtcactgtcgttcagctcgtaatcccgggtgtagtcgtcggaatcgtatccgtcggcgtagaaacagccgtaatcgtcaaagtcgtcatagtcggtgaactccacgtattccagttcgtcgtaatccgactcgtcgtagaagaaatcgtagaaatcctccgcgtccagcgtcacatcgtcgtccgggtccacctgataggtcaggtcgcccttgctactggtgccgctgcccttgccgacctcgatgtacagagtgccatataccttgtcaccgtccacgccgtgcatggtgaagtcaaaggccagggtgtccgcgtcggcgttccggtcggcgtagaacgtcagcgtgtccagttcaaagtcatagtcgtaccagacgtcgttctcgtcgtaatagaacatggcatcgtccagatcgctgtcattgagctcatagtccaggatatagtcatcgctgtcgtatccgtctgcgccgaaatatccgaagtcatcgaaatcatcgtagctggtgaactccacatactccagctcgtcatagcggccgtcttcctcgtcaaagagatcccagaagtcctcggcgtccaccgtcacatcgtcgccggggtccaccttgtaggtcagctccacgtcgccggagccggagcgggagccaccctccacatcaatgcggaccgttgcatagaatgacccttcgtcgccgtacagcctgacatcaaaatccagtgtgtcgctgtcgatgttgtcataggtctcaaaccgcagcgtgtccaggtcgatgtcgtaatcgtccgcatcagcacggtcatagtagaattcgtagttctccagcgccttggaatccacgtcgtcgaacccgtaacggtcaaagtcctcgaaggtgaaatagccgtaatcgtcaaagtcatcataatcggtgaattccacgtattcaaggtatccgccgttgtcgtcctcatagatttcctgaaagtcatccgcatccagccagacgccgctgtcctcgtccacatcgtacgtcagatccgccgaggccgcagacgccatgggaacggttccggccagcagcgccagcgccagcagacacgccgggagctttttcttccaaaatgttttcatagtcctctttcctccatcatattccaaaaggcttgcttccagcttctatctctctacatgtaacataccgggaaagtgcccggcaatcatgaacaaattatgaacttttcgccattcgggaaaaaagattccggtccggccgcatcctggaaaacgaaattgtcccctgaaatacacagacggcccgggattttccgtttttttacgggtttttctttacaaacaaacgttcctccgatataatactatggctaatgaaatttgaggaagtggagagagcacatggctttgatcgaatacgacgaatataagcagaggctccgggacctggggcccgagctggagaagctctccgccgcgctggacatggacagcgcccgcgcggaggcccgaaagctggaggacgagactgcccaggacggcttctggaacgacctggagcgatcccagaaggtgcagcagcgcctcaagcagctgcagaacaagatcgcccgccaggacaagctggtgaccgagtggcaggatctgacggccctgtgcgagatgggccaggaggcggaggatgaggagctgctggaagagctgaagtccggtttccagaccctggaggagaagatcgaggagtcccggatggccacgctcctctctggggagtacgacggccacagcgccatcctgaccttccatgccggcgccggcggcaccgaggcccaggactgggcccagatgctctatcggatgtacacccgctggacggagcgccacgacttcacctatcagatcctggactatgaggacggcgacgaggcgggcatcaaatccgcgtccatcgccatccagggggacaacgcctacggccttttgaagagtgagaacggcgtccaccggctggtccgggtgtctccctttgatgccaacgcccgccggcagaccagctttgccgcggtggaggtcatgcccgagatcgaggatgacgacgaggtggagatccgggaggaggacattgagatgcaggtctaccgggccagcggcgccggcggccagcacgtgaacaagacctcatccgccgtgcgcctcattcacaagcccacgggcatcgtggtggccagccagcaggagcgcagccagtttcagaacaaggacaactgcatgaagatgctgcgggccaagctggtggagctgaagcagcagcagcacgcggagaagatctccgatatcaagggcgtgcagatgaagatcgagtggggcagccagatccgctcctacgtgttcatgccctaccagatggtgaaggacacccgcaccggctatgagaccggcaacatcgacaacgtcatggacggcgatctggacggcttcatcaacgcgtatctcactcagctggccaccggtgagctgaaaaaataaatcgtccacgcatccttccggatgcccggctttccggagccgcaacctaatagagaaatcaaaatatgagacgtggcgcggggtggtctccgtgtcacgtctctctgaatgagaaaggatgttggaatttccatggcagaaaaattcccccagggcgcggcgccccaggagaacaagatgggcgtgctgcccatcggacggctgctgaccaacatggcggtccccatgatgatctccatgctggtccaggcctgctacaatgtggtggacagcgtgttcgtggcacagatcagcgaggatgccctgaatgccgtgtccctggccttccccctgcagaacctgatgatcgccttcggcgcaggcaccgctgtgggcatcaacgcgctcctctcccggtccctgggagagaagaatcaggccatggcggaccgggctgccaacacgggcatctttctggccctgtgcaatttcgcgctattcgccctgatcggcatcttcttctcccggaccttctttgagctgcaggccgggggagaacaggtgattatcgactacggcgtggattacgcctccatctgcctgggctgctccatcggtattttcagccagttctgctttgagcggttgctgcagtccaccggccgcacgttcctggccatgtgcacccagcttaccggcgccctcatcaacatcgtgctggaccccatcctgatcttcggctggttcggcctgccccggatggaggtggccggcgccgccattgccacggtggcagggcagattgtggctgccgccgctgccctggtgctgaacctcaaatgcaatccggacatccacatcctgccccgggagatccgctggcacggcaaggtggcggcggagatctaccgggtgggcttcccctccatcgtcatgcagtccatcggctccgccatggtgttcggcatgaacaagatcctcttctccttcaccaagacggccaccgccgtgttcggcgcatacttcaagcttcagagcttcgtcttcatgccggtgttcggcctgaacaacggcatggtgcccatcgtcagctataactacggcgccgccagcctgccccgggtgaagcggaccatcaagctgaccatctgcaccgccatggccatcatggctgtgggatgcctgattttccagctcttcccccagcagctgctgatgttcttcaacgcctcggaggagatgctctccatcggctccgtggctctgcggatcatctccgtgtccttcgtgctggcgggcttcgacatcattgccggttccgtgtgtcaggctatcggcaacccgctgtacagtctgattacctctgtgtgccgccagctggtggtgctgctgccggtggcatggctgttgtcccacaccggcgtcctgacgctggtgtggctggccttccccatctccgaactggtgtccctggtactgagcgctatcttcctgcgccggaccatgcgggccgttgccgagcggatcggcagccgggcggcctgactccagagaaaagcagcggcggaacggcctttgccgttccgccgctgctgcgtcagctgttgagaaatgcgtccgggtccacagcttccccatcctttgcaacggagaagtgcaggtgggcgccctgggcggcctccgccgcggcggtggttcccactgcgccgatggtctgcccggcggacaccgtgtcgcccgtctccacggcgggctccgcctggagattggcataggtggtctcatagccgccgctgtgctggatcaccacggtggtgcccatcaggggatcgtcggtgatggaggagaccgtcccggcgcaggcggccaggacggcatcgccttccgccgcggcgatatccaccccgtcgtgggtccgccagtcgtccagcgtctcattgtacagcagctggtccacggagaatgccgtcagcacctctccctggatgggcaggaccaccacatggggctcctctgccaccacgggcgtgtcatccaccgggatggtcacctccggcatgacgacgggctccgtctcctcctccggttcctccggaggcacggtctccaccaccggttcgtgctccggcaggtcctccaccggtgcggaggctgccgtgtccgggccggtgggcgcttccgtctgggccggttccccaaacagcagaaagtagccgcccacgcccaccgccaggacgcacagggccaggaccgcgtaaaagcctggcccgcccagcagggatttgactttatttgccatgtatcatacctccctcgatcttgggtctgagggaagtatgggcaggatttccaggaattatacaaaaagagaccgctggaaagcggtctcttttctctcagaaattggtcacttcacgatcagcgtcttgccgtccatctcctctggacaggccaggcccatcacgtccagcatggtgggggcaatgtccgccaagcggccgttggggcgcagctcggtccccgcgccgcagagaatgaaaggtacgggattggtggtatgggcggtcatagggctgccatccggctccgccatctgctcggcgttgccgtggtcggcggtgatcatggcgatgccgcccatcttcagtgtggcgtccaccacccggcccacgcagctgtctacggtctccacggccttcaccgccgcgtcatagacgccggtgtggcccaccatgtcgcagttggcaaagttcagaatgatcacgtcataggcgccggactcaatgcgctccacgcacttgtccgtcacctccgccgcgctcatctccggctgcttgtcgtaggtggccaccttgggggagggcaccagtacccggtcctcaccgggaaagacagtctcggacccgccgttgaagaagaaggtcacatgggcgtacttctccgtctccgcgatccgcagctgggtcatgcccatctggctgagatactcccccaggccattgcgcaccgtcacccggggaaggccacctccacattgggcatggaggcgtcgtactctgtgttgcacacgaaggtcacggggaaaaactggcgggtgaagccgtcgaactccgggtccaccagggtccgggtgatctcccgggcccggtcgggccggaagttgaagaagatcacgctgtcattgtcggagatggtgccctcggcatcacagaccacgggttccacgaattcgtcggtgacgccccggtcataggactcccgtaccgcggccaccgggtctggattctgcacggcgccctcgccgtacaccatggcgtcgtaagccgcctccacccggtcccagcgcttgtcccggtccatggcatagtaccggcccatgaccgtggcgatcttgcccacgccgatctcccggcactgtgccacggtctgcgccacaaagtctgcgccggaggtgggggatacgtcccgcccatccagaaaggcgtggagatacacatgctccaggccccttcgcttcgccagccgcagcagggcgaacaggtgctccaggtgggagtggacgccgccgtcggacagcaggcccatcaggtgcagggacgtgcccttctccaggcaggcgtccatggcgtgccggtaggcgggattttcatcaaagctcccgtcggcaatggctttggtgatccggggcaggtcctggaacaccacccggccggcgccgatgttggtgtggcccacctcgctgttgcccatctgcccgtccggcaggcccacgtccaggccggaggcccggagcgtggtgtgggcatactcccggaaaaactggtccagccggggcgtggcggcggcgcggatggcgttgccctccgtctcctgccgcaggccgaagccgtccatgatgatgagggttgttggtgttttgttcattgaaatctcgtctcgctcgctttctcacaaaaccgctctgccggagctcactcctggttggctgcgttgatgatgtccacgaactggtcgggcttcagggcggcaccgccgatcaggccgccgtcgatgtccggctgggccagcagctccgccgcgttcttggggttcatggagccgccgtactggatggtgacgctgcgggccacccgggcgccgtacaggctgcggatggtggcacggatgttggtgcagacctcgccggcctgctcggcagttgcggtcttgccggtaccgatggcccagatgggctcataggcgatgatgcagcggcgcagcttgtcggcgggcacgccgtacagggcgctcttcacctgaagggcaatccactcgtcggtgatgccggtctcccgctgctccaggctctcgcccacgcagatgatggggttcatgccggcgttcagcacggcgtggaccttcttgttgacggtggtatcggtctcgcagaaatactgccgccgctcgctgtggcccacgatgacgtacttcacgcccagatccttcagcatgtcggcggagatctcgccggtgtaagcgcccttctcctcaaagtacacgttctcggcgcccacggagatccgcaggtccttgaacgccttggcggcggtctgaatgttgcaggcagggacacagatcagggtgtcgcaccacttggcccggggcatgatcttcttcagttcctcggcgaatttcttcgtctcagtggcggtcatgttcattttccagtttccggcgataaccgttttgcgatatctgcgattcatggtgatctcttctcctttatgtcttcatctatccgcaatcgcgttctccgcgatctgatgcgcaggttttggccgtttccagggcattttccccgaaaggcccttttttttatacagaattccagcccgtttgtcaagtcaaatgaagcgcgtttggggacggattcggcgcggccgccgcaagcggccgcaacattcaaattcattttcgcctcagggcgtgcgtggcgaaaatactttgcctcagccgccctgggcggtgtcaccagtccgcagattggtgaggaggaatgtaaaggggggacacagtccccctctttaagcatccgggaggcaggccacgcggggcagctctttgccctccaaaaattccagcggcgcgattgacggctccgggaggaaccgggaaacgcaatgccgcaacggtggatcggcggcacagcagcttactgatcaaggaggcaggccacgccgggcagttccttaccctccaggaattccagggaggccccgccgccggtggagatgtgggtcatcttgtcggcgtagcccagctgctccacagccgccgcgctgtcgccgccgccgatgatggtgatggcgtccgtacggctcagggcctcggccacagcctcagtgcccttggcgaaggccgggaactcaaagacgcccatggggccgttccagatgacggtgcccgcgtccgccacggcgccgcagtacagcttcaccgtctccggaccgatatccaggccctgccagccgtcggggatctccccggccttcaccacctgactcttggcgtcgggggcgaaggcgtccgcgcagacggtgtccaccggcagcagcagctttacgcccttctcctttgccttctccaccatctcattggcgtagctctcccagtcggcctccagcaggctgtcgcccaccttgccgccctgggcggcggagaacgtataggccatgccgccgccgatgatgatggtatcggcgatgttcagcaggttgttgatgacgccgatcttggaggagaccttgctgccgcctaagatggccaccaggggccgcttgggatcggcgatggcaccgcccaggaactccagctccttctggatcaggaagccggagacggcgggcaggtacgccgccacgccggcggtggaggcgtgggcccggtgcacggcaccgaaggcgtcggacacatacagatccgccatgtcggccagcttcctggccaactccgggtcgttcttggtctcgccgggctcgaagcgggtgttctccagcagcaggatctgtcccggctgcagggcggccgccttggtttgggcgtcggggcccactacgtcatgggcgaagatcacttcccggcccagcagctcgctgaggcgcttcgccaccggggctaggctcagcttggggtcggggccgttcttgggcttgcccaggtgggagcaggcgatgaccgccgccccattctccagcagatactggatggtgggcagcgccgccacgatgcgcttgtcgctggtgatggcgccggtctctttgtcctgggggacgttgaagtcgcagcggagcaggacctttttgccccgtacctccacatcccggaccgtctttttatgggtattcatctgagatgtcctcctatctgatctcgttccattggattcctcatgattcattccaacgcagccgaagccgcagaggcgttcggcggcggtgtcagcgcgttcagggactagtatggaccgaaggatggaaattcacccccggccgccccccctgcaatgcaaggccgctccgcgccctgcaaaagcagccgggcctccccagcggaatcggcgccgcccggcggggctcagccccaggccatctcgccggttcccagcaggcccggaaacccgttctgccgcagcgcctcgtagacgcagacggccacggtgttgctcaggttcaggctgcgggcctcgctgaccatgggcaggcggacgcagcggtcccggtaccgctcccggagagccagaggcagtccggcggtctccttgccgaagaacagccagctgtcggcggtgaaccgggcctcctgataggaccggggcgccttggtggtggtgagccacaggtcccgctccgcctcggggcggcggcggaaaaagtcctccagattctcgtaatcaaaaacctccaccaggttccagtagtccaggccagcgcggcggacggccttctccgagatgtcgaagcccagggggcggatcaggtgcagctggctgccggtggcggcgcaggtgcgggcgacattgccgcagttctgtgggatctccggctccaccagtacgatatgaagcatagacagctgtccccctcttttcatgcagtcaaaacacattgtaccgcgtcgccccggcaaattcaactgtaatgtgtgaagaaaaccggatttttagaaaaaatcacgacaaatccggctggatttctgcaaaatgccggaaatgacagaaggagggggcgccgcaggagcggatctgttgtctcccacaaaaaaacgtccctgtacaagaaaaatctggaggaaatttcttttataaattcgccggaaatactggattttcccaagatatttgttataataaaaaatacgaacgaacaaggaggagaaaacccatggattttccgcagcgcgccgtgttttttctggaagaggactcctccctcccggcgcactccaaaccgctgatgctggaagccgtgttattttgcccgatcctaaaatggatgagtgacaagctgttggccgacggcgtgcagcggttttttgctgtctccagcccccgctttgcccaggaggtccgcgcctgcttcccggaggacgcagacgtgaccatctctgagcagcacagcgagctgctggactttttgaacacgccggacccggtggccgtgtttgtccgggccgcccttcccatggaggaggcgggccccggctttgtctacggcgccgccggctacgagctccaggcggtctggcaggagaagatgaccaatgccgtctccgcggcggagctgatccccggctgggtgccggttttcagtctggagaccgtggccgagctggagcccctgctccgggagcggatcgtccggcggcacatccgcgccggcgtccgggtgctggacccgaacgcggtgtatatcgacccccgggtcaccatcggccgggggaccatgctcctgcccggcaccatcctgcggggggagaccgccgtcggctgcggctgcaccatcggtcccaatgccgtggtgcgggattgcgtcatcggcgatgagacagagatcaatgcctcccaggtgaacgagagcaccatcggcagccgcacccacgtggggccctttgcctacgtgcgccccggctgcgccatcggggatgacatcaaggtgggcgactttgtggaggtgaagaactccgccatcggtgacggcaccaaaatctcccacctgacctatgtgggggacagcgacgtgggccgcaaggtcaacttcggctgcggcaccgtcaccaccaactatgacggcgtgaagaagtaccgctgcaccattgaggacggcgccttcatcggctgcaacaccaatctggtggcgccggtgactgtgggcgcgggttcctatatcgcggcgggtgccaccatcaccaaggatgtgcccgcggacgcgctggccgtggccagggccaagcaggagaacaaggaggggtgggccaaacggcggcggaagctgtacgggcaggagcactgatgctccttcggctgatcgatcctactgacagaaaccaagaacattcagaacatagaaagagggcgttcaaacaatgatttctcacggcaaggacatcaaggtgttttccggcaacgcgaatccgaagctggcggaggagatctgcaagttgatgggaaccaaactgggcgaggcggaggtcggtaccttctccgacggggagatcttcgtctccctgtacgagacggtccgcggcagcgacgtgttcgtggtccagtccacctgcaccccggtgaacaacaatctcatggagctgctcatcatgatcgacgcactgaagcgcgcctccgccggccgcatcaccgcggtcatcccctactacggctatgcccggcaggaccgcaaggccaaggcccgtgaccccatcaccgccaagctggtggccaacatgctcaccgccgcgggcgcggaccgggtgctgaccatggacctgcacgcctcccagatccagggcttcttcgacattcctgtggacaatctggcgggcaaccccatctttgtggactactacgccaagaagtacggctccgagtgcgagaacatgatggtggtctctcccgacgtgggctctgtgtcccgggcccgggcctttgcccagaagctgcacatgaatctggccatcgtggacaagcgccggcagaaggccaacagctgcgaggtcatgaacgtcatcggcgacgtgcgggacaaggactgcatcctcttcgacgacatggtggacaccggcggcagcctgtgcaacgccgccaaggccctgatcgaggtgggcggcgccaagagcgtccaggcctgcgcctcccacggcgtgctctccggcccggccattgaccggatcaacgacagcgtcatcaccgagctggccctgctggacaccatccccgccattgatcccaaaaagagcagcaagatcaaatacctgcaggtggcccccatgtttgcagaggccatcgagcgtatctaccaggagatctccatctccaagctgttccgctgagaagcggcggagctccggcatttctgcgtatcaataatggactggtcaaggcggggaagggaactttcccgccttggctgacgttgcaaaggagtttttttcatgctgttaggcgccaaatccgccgccgtggactggctggtggtgggcctgggaaatcccggggccaagtatgagcacacccgccacaacatgggctttctcaccgtggacctgctggcggagcaggcgggggtgaagctgaacaaggtcaagttcaaatccgcctataacatcatccccttcgccgggtccaagtgcctggtgatgaagccccagacgtatatgaacctctccggcgaggcggtgcgggaggcagtgcagttctacaagatccctgccgaccacgtgctggtgatctatgacgatgtgtcattgccggtggggaagctgcgggtgcggcccaccggctccgctggggggcacaacggcatcaagaacatcattgcccacctggggacccaggacttcccccggatcaagatcggcaccggcgcgccgggcgaagggggcgacatgatcgactgggtcatcggcgtgccctcccaggcggagcggaaggtgttggtggagagcttccgccgggccatcgacgcggcggaatgtatcattgaacatggctgtcagaaggccatgaatgacttcaattgaatgagggccgtccaatagggcggctcgccgcgcctctttttgccgccgggcatggcgcccggtaaaggggaatacactaaggacggatccattttcccggatcgtgccggtggatatgacctgggtgggagaatcatgtccatccgctttacagcccctgcctccaaacaggcgccgggcggagaacgcccaccgggccatgcgcccggaagcggcccggcgcccagagagtcttcccaatttttcatgttgacaaggaccacatcctatggaacagtttctgagacaattgcagactatccccgaggcggcggagctgatccgccgggtggaggagggcggctgtcccgcggcggtcagcggcctccagccggtgcagcgggcctgcgtgggcgcggcggtggcggcagcctgcggccgtccggcggtgttcctctgcggggacgagcgggaggtccaggtcctctccgctgatctggagaccctgacgggccgccgccccgtgaccctgcttggccgggagtggcagttccgccccggggccgtgggttctcgggactgggagcggagccgtctggcggcgctgtacgccctggcccagggggacgcgccggtggtggtggccaccgcggacggcctcatggcccggaccctgccgccggagaccctgcggtccctggccatcaccctggaggtgggggggcaggcagagctgggcgcgctggcggagcaactgctctccgccgggtatacccggtgcgagcaggtggagggcgtgggccagttcgccctgcggggcggcattctggacgtgttctctcccctgatggaccagccggtgcggtgcgagttttttgacgatgagatcgactccatgggcgccttcgaccccggcacccagcggcggacccggaacgtgtcctccgcccggatcctgccggcggcggaggtgctgccccactgcgcccccggaggcctgcccggtcttgcggaccagctgaccgccctggcggagaagctggcgaaaaagcagaagacggaggccatcgtccagacgttgcgggaggacgcggagcggctgcgcagcggcgcggccccgggggcggcggaccggtatctggcagccatctatccgactgtcaccgccggggtccactacctgcctccggacgcggtggtgttcctcagtgagagcggccgggtggacgagcgggtgaagaacacggtcctccagcagaagcaggacgtggaggcgctgctgtccgccggggtgctggcgggggagtacgcccatctgaccctcaccgccgaggaactgtacgccgcgctggaggacttccccgtgatcctggaggactctctgcccacctcccggcaccccctgcggccccggggcctcctgaccatgaatgccaaacagctcagctcctacggcggcagcctggagaccgccgtcacggatctggagcactaccgctcctccggcagcgcggtgctggtgctctgcggtggggagacccgggcgaagaatctccaccggctgctggaggagaagggcatcccggccaccctggatctaagcggcgccgccatgcctgcggcgggggaggtgcgcctctccctgggggccctgtccgctggcagcgagtggccggcgctgaagctggcggtgctgacagagggccagctgacggccccggccatgcgcaagcgccagcgggtgaagaaggactccaaccggcagaagctccagtcctacaccgacctgtcccccggagacctggtggtccatgagcaccacggcgtgggccggttcgtgggcatccagcggatgccggtggacggcgtggagaaggactacatcaagatcgactacgccggcggggactgcctgtacgtccccgtgacccagctggatctggtgagcaagtacatcggcggaggcgaggacaccgagcgcaccaagctcaataagctggggggcgccgagtggacccggcagaaaaccaaggccaagaaggccgccaaggatctggccaggggcctcatcgcgctgtatgccgagcggcagaagcggccgggcttcgccttctccccggactccccctggcagcgggaatttgaggagtcctttgactacaccgaaaccgacgaccagctgcggtgcatcgcggagatcaaggcggacatggagaagccacggcctatggaccggctgctatgcggcgacgtgggctacggcaagacggaggtggcactccgggccgtgatgaagtgcatcctggacgggaaacaggccgccatcctggtgcctaccaccgtcctggcccagcagcattacgccaccgctgtcagccggttccgggactttccggtgaagatcgaggtgctgtcccgcttcacccccgccagggagcagaagcggatcctggaggccgccaaaaacggcggcgtggacctgctgatcggcacgcacaagctgctgcagaagagcatggcgttcaaagacctgggcctgctggtgatcgacgaggaacagcggttcggcgtcacccacaaggagcggctgaaggagatgagccgccaggtggacgtgctgaccctctccgccactccgatcccccggacgctgaacatggcactttcgggcctgcgggacatgtccaccctggaggagcccccggcggaccggcagccggtgcagacctatgtgctggagcacgactgggccatcattgaggatgccgtccgccgggagctgggccggggcggccaggtatactacctccacaaccgggtggagagcatcgacgccaccgccgcccggctccagaagatgctggggccggaggtccgtatcgtcaccggccacgggaagatgacggagcaggagctgtcctccgtcatgcaggccatggtggacggggaggcggacatcctggtctgcaccaccatcatcgagaccggcatcgacatccccaacgtgaacacgctcatcatcgaggacgcggacaagatggggctggcccagctccaccagatccggggccgcatcggccgcagcgcccggcgggcctacgcctatctcacctaccgccggggcaaggtgctgcaggagaccgccgccaagcggttggcggccatccgggagtatgtggagttcggctctggcttcaagatcgccatgcgggacctggagatccggggcgcggggaacctgctggggccggagcagtctgggtatctcatgagcgtaggctacgacctgtacctgaagctgctggaggaggccgtcctggaggagcgtggcgaggagaagcggatcgagacggagtgtgccgccgacctgacggtgaacgcccatatcccggaccggtacgtcccctcggcggaacagcggatggacctgtaccgccgcatcgccgccatccgcacggacgaggacgcctcggatctgctggacgagatgctggaccgctacggcgaggcgcccaagtccgttctggccctgctggacgtggccctgctgcgttctgccgcggccaaggccggcgtgtccgatatctcccagaagggcagcctcctgcggctgcagctgggagtgttccacccacaggccctggtggcggtgtgcggccacgccaagtaccgccagcggctgacgctggcggcgggggagatccctgccctcaccctgaagctcaagcccggggaggatgtgctggaggccgcccgggacctggtggaggacctgaagctggccgcggaggaggccgcgggcgggaccccgtaagtttcatcatgtttttgccatgccccgcataggatggtggcggtgggacgtcccccgcctgtcctgtgcggggcgtttccacggaatctgcgaggaatgacaaaggagaaccgtgatgaaacgatgcatcgctttttgcctggccctgggggccgccatctctctcaccgcctgcgggggcggagacacagaggggggacttctctgcgaggcgtccggcatccgtccggacactgtgctgctgtccgtggacgggcgggacgtgtccgcccagcgatacctctactggctggcctacgcctgcgactacattgccgactactacgacagcggggaggggatccagtggggggacactgtctccggccagagcctggaggattacgccaaggaccaggcgctgcagaacgccgccctgtacgccacagtggagacctgggcggaggattacggctgcaccctcaccgacgaggaccggactgccatggaccgggagtgggcggcccgggcggcccagtacggcggggaggaggcctatctggccgtgctggcccgcatggggctggaccgggcggaagcggaggccatctccggggactactatctctacgagcacctgtacgacctctactgcacggagggcagcgagctggcccccgcggagcatgacctggagacctttgcccaggagcagggctacctcaccgtggaccacatctggctctccaccgccgccgcggacccggcggacgcggaggccgtggccgcctgccgggccagggcggaggaggccttttccaagctgaacggcagcgcggaccctgcccatgactttgctgtcctggccgccacttacagcgatgagacggaccgggaccagcatccgtccggatacaccttcactgtgggggacggcacgctgcccgccgcctgcgaggaggcggcccaggccctggaggagggccagttcagcggcgtggtggaggcggatgacggcttctacctgattctgcgcaagcacgtggacctggaggccgtggccccggactacttcgacgccctgctccaggctgcggcggacagcgcggacatctccaccacccgcacctatgcggacctggatgtgagccggttttacgacgagctcatcgccgcccgggcggagctggatgcctccggcggagaggttgcctgatgggtgtttgtgccaattttggcaaaatgacgaaattcgcagaggttttgataaagttttaacaaattttcgaatttcacagaaatttgcattgacggggcaggaaaaacccagtataatcaaatcagcaagcggttggtgtatgagcatttgtcaaaaatttggcaatcatgtttttcttttgacaaactctcgccgccaccctcaacttgtgattggcgtctgcggcagcgcctgacgaagagccgtcggagctgccaatcccatatttttataaaaacggaggaagatcatgaaagagctctatgttgtgaattgctgcagaaccgcgattggttccttcggcggcgcgctgaagaacacccctgccgtcgatctgggtgccatcgtcatcaaagaggctctgaaccgtgccggcgtgaagcccgagcaggtggatgaggtcatgtttggctgcatcctgaccgccgcccagggccagaacgtggcccgccaggcctccatcaaggccggcatcccctattccgtccccgcttacaccgtgggcatggtctgcggctccggcatgaagtccatgatcgagggcgcccgctccatcctggccggcgacgccgacgtggttgtctgcggcggcactgagaacatgagcgccgctccctacgccgttcccaccggccgctacggcgcccggatgggtcacacccagatgatcgacaccatgatcaaggacggcctgtgggacgcctacaacaactatcacatgggcaccaccgctgagaacatcgcggacatctggggcatcacccgcaaggagatggacgagttcgccgcctcctcccagcagaagaccgaggccgcccagaaggctggcaagttcgaggctgagatcgtccccgtgcccgtgaaggtcaagaaggacatcgtggagttcaaggtggacgagttcccccgtgccggcgtgaccgccgagggcatctccaagctgaagggcgccttccccgtgggccccgagtcccccaatccccaggtggtccacacctttgagcccaccggcatccaggagaccgacgacaagggtcagcagcgcgtgactgccgccaacgcctccggcatcaacgacggcgccgccgcactggtgctggcctccggtgaggctgtggagaagtacggcctgaagcccatggccaagctgatcggctggggccagggcggcgtggatcccaagatcatgggcgtcggccccgtgcccgcctcccgtcaggccatgaccaaggccggcgtgaccatcgacgatatcgacctggtggaggccaacgaggcgttcgccgcccagtccatcgccgtggcccgtgagctgggctttgacatgagcaaggtcaacgtcaacggcggcgccatctccctgggccaccccgtcggcgcgtccggtgcccggatcatcgtgaccctgctgcacgagatgcagaagcggcccgaggccaagaagggcctggctactctgtgcatcggcggcggcatgggcgttgccaccgtgttcgagaagtgctgaattgatcttccggcagagcaccgtctccgctggatgtgaaaaggcgtccccggccattagccgggggcgcctctttttttgtgccgggaagcggcgtgccgcagggccgccatccagcagaacggcaggaggacgagggtataaaagcgcctggaggcggcctgagaggatgccccagcagtttgcggatcgcacatcagccggagtttttgcagggaccgcgctatgaaaggcacctggcagccgctggaatgcggtggaacggataagaaggccgctgtaagccgaaaactggcttacagcggctgacttggcacccctgaccagactctaactggtggcctaccgcttaggagtacggcgtaccatttcgtaaattgttcatatcatatcttcccgtgttgtttcttcgcaaattgtgctgcctggaggcaggtcaatttgcacaaattcccctgaaatatgctgccttacaacggcttttcaaatgtcgtattagcaaggtattagcaggaaccccttgtgacagagggcttccaggggccgtttgaaaatgctattagcaagggaggatcattttatgagcaccaacgaaaaagggatgccccaaagcagaacatacaccgtgaatgacatcgcagccattctcggtatcggccgcgcctcggcctataaactagccaactccggagcgttcaagacaatccgcatcggcaacatgattcgcatctccagaaagtcctttgaggattggctaaaggcagaggggctggacgacgaaacggaataagtgcttaaactgccgcaggctgttagtctgcggcaatttaatatagtagacaatttaaaaggacctggttttttagctttgcagtattgaaatatctgcagaaaatctatcaagttttgcgctttcttgatgtaactctctgcgagccgctcttaatttttcttctatgagtgcaagtttttcttcggcactctctttttggcgcacagcatattccaccttttccgctgaatagcgccgcaaattcgcttggcggttaaacagtgcttttctcgcttttgatattagagaaagaattttgatttcgtctttattccaaatcgtcaaaattattatgaatattgaaattacagccgtaataatgcctaatacttcagaataatttgtgccaatgtaaactgcaagtcctattgctattaacgatgctattgttattattatttttaaccctaaaatttgtttgttgacagacttatcaattgcatcttttacctgatcttgttcactcagaaattcagaaacatcttctatctctttctttacgtccgttctatctttctctaatacctcaacattccgctggcactcaaaaataatcctttgttgtttagcttttgcaagttcaaactctgccgtttcgtttttccttgttaaattatcaatttcttcttggcgcgatatgcttccttccgtatatgcactctgacgaatttcctttagaatttctagcggtgtggagtctataatcttatcagaagcatttgccgttagttttccgagaattctttgagcaacagggctaactttcaagaaatagcattgctccggagtaatatcaccttttttctccaactttattagcgcatcatttaatttttttgtaacatcattagaaggtcgaaatgcagcatatgcagcagaaaccagccggggcctattaatcgaagatagtgtagacgggctattaaaccagacaagagttccccatttaatgtcggtcataacggttggtataaagaaatcctttgatccagcaaattctagagaaatcttatatccaacccgtgccaatgatctatttccggtgataaaaatgtttttgacctcatttagatgatacggaacaactgtattgtttttatgttgagtaaagaaaatggatttagcatcttggttaatactataatccttatcatcaatttggacatcagggttcgattctttgtattccgagacaatcatttctttaataattgcttctgtcggagtctgtatatcttccactttgggatatggcatattgtctataacgatattaaaatcttcttttaagcgagttcgtacattacaagagaactcatcaatttcatctatgctccactgattgcgtacaaagaaataagttgcttcagaagaaagcgttgcatcataattgggattgttaatccacgactttgaaccttcgatgatgccgatcatttcgctaacggtatgatcatataccttgacatgcatgcctagtttttggatatttctgacaaatagttcatagctatcagcacggtcagagctatcaataccaaatagcttaaacagtaagccagtatccaaatacacacatgcgtccttagctgtataagattgaggagattcacaatatgcaaagacttccgacaatgctaggccaatggtataatcgttcaaatagtccaaaatgtcggcctgacctgtttcttcacaatggaccaaaaaagctgcaaacaaataatcgtctttgacttctcttaacacccttctatctactttagttttaatgccatatcgctcaataaatgcaagtattttgtcacccatatcttcatcagaagaatagatgttatactcttgttgcaaaaaaactttgaatcgagcaaggatttctcgatatttttggtctgttttttcaacaatatccataaagtcctcttcatcaatatgggcatagtcagggacaaactgatgtatagaggaattatatgttagaaacccaaagttaatacatgtagaaagaattgtttgcattggatgatagggaactgaaaagccataataggctttgaaatctttacatagagtgtctatatcgcatgttttgtatctatttctctgtatgagagccgcaatcattctggcataagcgtggagtatatcttctctagaacaggaacttagagcagcatagcaggctattgtcgaaaatgagctcatggctgttacctctctgtatctattttggggtaaatttcattttaaagtataaatccaattcaggtaaatttcaattctatgagtattgatttctgacataaatcgactttccttgtaaatctcaagaacagagcagtttaaaggtcataggtttagtcctatggccttttttcatatccatttgtatctttgtatcatttattctggctctgagattaccacaacgatattctgattaccaagtcaaaactgacacgaaaggagtcgaaaatcccatgttttttctcccacagtcagccggaagtccccgcccataggttttcctctccggggtatccgggcggcatagataccgcctttctcccaaaaacgaacacttttccaaaccgctgaaaggaggtgataacatggcggtatttcgcattgaaaaaacccgagactacacggtgatgtccaaccaccacctgcggaatgcggggctgtcgctgaaatccaaagggctgctctccatgatgctgtccttgccagaggactggaactacaccaccagaggcttggccaaaatctgcaaggagggtacggacagcatcggttccgccctgaaggagctggagcgggccgggtacatagtccgcaatcggctccgggacagcaagggcaagatcgtggatgtggagtatgtcatctacgagacaccccatcccccggacacgggccagccgtgtgaggatgagccggatacggcttgtccaaatacggaaaacccggatatggataacccatgtctggaaaaccggccgcaattaaataaagagaaaagaaatcctgaagaacaaaatactgattcatcaagtacggaaggatcaaatccaatccaatcaagcccccaaacccccgcaggggccaaccggaccggacgggactggatgcgggagcgagagagctatcgggaactgattctggagaacatcgagtatgactatctatgccgggatgaccggctggatcgggatatgctgaatgagctggtggagctcatggtggataccgtctgttcccgcagggagacgatccgcattgccggggacgactacccggcggaggtggtcaaatcccgatttctgaagctgaacagttcccacatcgagtatgtgctggaccggatgcgggacaacaccacctatgtccgcaatatcaagaaatatctgctggctgctctgtataacgctccggccaccatcgacagctactatgcgtccctggtgaaccacgacctctacggcagcggagaaaggagatgataggtcatgcaggaagaagtcacccagcgcaccgttgccctctgtgtggaggctacaaagctctccgccgggatgctgcaacaggccatgaaaaaagtgctggacgagatgcagaaaggagtgaccggccacaagaccaagctgcaccacggcaagcagaccctccggcagttgatgaagcacaataccggcgtttcaaacatcgagatcactgaccagaacatccgggccttttccgccaccgccaagaagtacggcattgacttcgcgctgaaaaaggacaccagcggcgagataccccgctacctagtgttcttcaagggccgggatgccgacgttatcacggcggcttttcgggagttttctgcaaagaacctggagaaagagaaaaagccctccatccgcaaggagctggaccaggcaaagcaacaggccaaagcccaacaccgccagcgggagaaagtcaaaaccaaagaccggggtgtggaattatgaccgacacctggaaaaaggctctcttcctcaatctcccgtatctgctgtttgtctatctctttgataagctctgccaggcggtgcgctttgcacccggccttgacgcctctgaaaagttcctgcatttgagccagagctttacggaggcgttttcttctgggctgcccagcctgcatccgctggacctgctggcgggtatcgtcggggcggtcatcgttcggctggcggtatacgccaaagggaaaaacgtccgcaaataccgcaagggcattgagtacggcagcgcccgatggggcacggcggcggatattgccccctatgtcgatccggtccccgactggaacatccctctgacccagacggaaaagctcaccatgtccagccgcccgaaaaatcccaagtacgcccggaacaaaaacatcctggtcatcggaggcagcggcagcggtaagacccgtttcttcgtcaagccctccctgatgcagatgcacagcagctatgtggtcaccgatcccaaaggacagcttttgtccgaggtgggaaccatgctgcgccggggcgcccccaagctggacgagaacggaaagcccatgcgggacgcccgcgggaaggtcatctatgagccgtaccacatcaaggtcctcaacaccatcaacttcaaaaagagcatgaaatacaaccccttcgcctacattcggtcagagaaagacgtcctcaaattggtcaatgtcatcatcgccaacaccaaaggcgacggggaaaaatcctccgaagatttttgggtgaaggccgagcgccttttgtactgtgccctgattgggtacatctggtacgaggcggagccggaggaaaagaacttcctcacgctgctggagctcatcaacgcatccgaggccagagaggatgacgaggaatttcagagcccggttgacctgctctttgccaagttggagaaagagcacccggaccacttcgccgtgaagcagtaccgcaaattcaaattggccgccggtgttgtatgctctaaaagacttcttaatcaagcagttgggaagtctcttagaacacacaacccaaaatcgaagaaaggagcgcaagttatgagaaaaaatgagaaaatcacagctctgtacgaacgactgagccgtgatgactttggcaaagatgatgaccaacagcgtgagagcaattccatttccaatcaaaaggctatgttggaggagttcgccgcacggcagggctttacaaacattgtccatttcacggacgatggtattagtggtacttgctttgaccgtcccggatttttagcaatgatgaaagaagtggaagccgggaatgtggagtacctgtgtatcaaggacatgagccgcatgggtcgtgactatctgaaagtcggtcagattatggaaatcctgcgtcagcgtggcgttcgccttatcgccatcaatgacggcgtggacagtgccagaggggacgatgattttacccctttccgcaacattatgaacgaatactacgccagagacaccagccgtaaaatccgttccactttccagtccaaaggcaagtccggcaagcacctcacaggcacggtcatttacggctatctttggaacgaagccagagaccaatggttggttgaccccgaagccgccgaggtggtcaagcgcatctttgccatgacgattgacggctacggtccgtatcagatcgccagcaagctgaaagaagaaaaagtcctcattccgtccgcttaccttgcccggcacggcgagggcgtgaacaaaaataagaccttcaaagatgtgtacggctggggttcttccaccatctgcaacattcttgaaaagcgtgaatatctgggacacaccatcaacttcaagacccgaaagcacttcaaggacaagaaaagccattatgtcccggaggacgaatggacaattttcgagaatacccatgaagctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgtaccaacaacggcaagcgtatttctcaatatacctgttcccaatacagcaaagtcccagttggaaagctctgcacgacacagcaccgtatcaatgaagatgtggtactgtcccttgtttccgaaatgctcaaagctattgccgagtatgcgaagcatgacagagccgagtttgtccgagtggtgcaggaagcgcagtccagccagcagacggcagaggtcaagaaacagcggatacgccttgccaccgcaaagcagagagtttccgagctggaagtcctgctctgcaaaatctatgaggacaacattttaggaaagctgtctgacagcagatatgccactctggacgctcaatatgaaaaggagcagaccgagcttaccgctgaaatctctgttctggaaaaggctatcaagagctacgagaagcacgaaaaggacgctgaccgttttatcgctctgattgacaagtatgagaacttcgacaagctgacgattgccatgctcaatgagtttattgagaaaatccttgtgcatgagcgtgaccgcaagggcagtattcagaccacacaggaggtcgagatttacttcaatttcgtgggtcgtttcgttccccctgcgtttggcgaagtggagcttaccccggaggaattagaggaaatccgcaagcgtgaggaacgcaaggacaggctccaccagaactacttgaagcggaaagccagcggagcacagaagcgatacgaggacaaaatcaaaaagcggaaaaaggcagaaatcgaagccaagaaagccgccattcgtgcggaggacattgcaaagggcgtgttcgtccctgtcagcagtttaccgcagagagagccgatgaaaggagtacaaacagcatgaatatcacttacacacagaacggcgattatcttatcccaaacatcattatccgcaagaccaagcccctcggacactacggcagacttcgcaaggcgtatctggaaatgcaccatccgatactgttcaatgagctggtgctatccgacaagctctttgagcattgcgccgagattgacgaaacagcacgaaaccgcatggagctgatcgtgcggtcactggcagagcaaaacggcgtgaccgagcaactgaaagccgaaaaccaaatggaatgggtgcggcagatgaacgcttgcaaggcacaggcagaggagattgtgaaagtggaattgatttatgattgagcgaggaagtccgggcagaaaactgttcggacttttctcatgtagtccaaagttgcggtagaattgttcacgagttttatggtacaatttatgcgaataaagaaaacggaaaattagaatctaacaagagaatgtggttgtatgaaaaaatccatattagtattttgggcaatcgtgtgtctgttacctattcaaaggaggtttaagaattttaaatgaaacatataagaaatatattgctgttgattacgattatttttgcttttgttatgcaagctgaagtatatcaaaatatgctctggaactttaatggtgcttattatttatcgtccagatacacaactactaatgacgatatggattcatttttagccaatgcagaagatacagctgagaagcatggtgttcatattttttcgacttttaatcagagagtttctaattatcagacaagactttatatttatggtgatgataccgttgttcgggatagtcttaaaagcacaatggatattgaggaaaaaacatatacggctttgataggcggaatcaccgtaatagaatttgaagattttagagaagcaaaaaacacaggcaatggacaggaaataatggtcagctatatcggtgacgatgatgacattattgccacatatcaagatttggcaaaagaatattctatatcgcagccagagttttggcaatcaaccgaaactgatatgatgttcattgtttggggcctggttgccatattgatgattgtacttaatatgattgaggtgatacgcagacaaaaggaagtagttgtacgagcttctctgggcgaaaatgctgctgtgattgctctaaaagctgtagtggctgatatgatttcatatgctgcattattcgtcttagcaaagttgcttgtttctcaatttatatcgggagcgtatgaagatcatctcattttggcagtgtattgtgccggagcagttctttccgtaattccttatgctgcttttgtccgctttgatgtaaaaaaagcctttgccaatgcttcagataaaaaaggtatgttttatcttctgaacggtcttaaagtatttgctactgctatgacgatttttacaataactacaaatctcagtagcattcaaggtaatttacttacaaacactactcttttagaaaatcattataatgattactattttggagttatgcagattgaacctccttttgaagaaaatgaggaggaatccaaagagagcgaattttggaatgacctttacgaaaatgaatacaacactataaatccggtggtctgcataggcagccggataagcgatacggataattatatttttgtaaatcataatgccagagatatgctgcaagggttttctgatatgcttactgaagatgatgaaaaagaggatatcgtggtcttcgtgccaaagggaaaaaatgcggaatcatacaaagatatcgcaaaagaggaaattgactctcttacccaaaatgcagaagaactgcgtgttgtttataaagaatattctggcagagagcaattttattatctcaattcgaacagagaagaggctattgacggattgtcaagagcaacaaatccgattgttatttatcaggcaaatgaggctgttgctttgaatggaagttatatcgaaacaggaacatataatggtgaggtgatctacggatgcgatgaaagcacaattcgtaatgctgcgaaaaaatatgcagaacagcttggtccacactattttatgctgacgaatgtcggggaggattatacttatagtcatagtttcctcgtgaaactgattggctttataagctctctttgcgtattagtattgctgttagatatcgctatcatcatatctgaagtgaaaatggaatttagacttaatgcgatggaaatctccctcaaaaaggttttgggctatcgcttttatgaaaggcacaaaagatttatttccgttaatctcttagaaaatatagccgttgtgatattgatttgcattgtttcgctttttatatctaacgcaagtgtcgggattgctttactggttggagcattgctcaccattattgaaatggcaatcattttcacaaatgttatgtgggttgaaaaaacaaatatctcaaagtccttgaaaggtggatgtttatgattataattcgtggcttaaataaagcatttggagagaaaataattttctccaactttaatttggaaattccggatggaagttttgtagtaatcagcggggatagcggcagtggaaaaagcactttgctcaatatgattggtggtatcgaaaagccggatagcggcagtatcataatcgaagggctgaatattacccggcttaaaaataaaaacagtttttttgcggatacagtggggtttctttttcagaattttgcactgcttgaaaataagacagttaaagaaaatttaagtttgattaaaaaatcaagccgaactaaagtatcacttaaagaagctcttaatcgtgtggggttatcaaaggaagttaacaaaaaagtttatcagctttccggtggtgaacaacagagagttgctttagctcgtcttatgatgaaaaaatgttctgttgttttggcagatgaacctactggctcacttgacaagaaaaatagagatattgttatgaggttattgcacgaactcaatgaagaaggtaaaacggttatcattgttacccacgatcagggtattattgaagatgaaccttatgttgtgaaaatctgagagtacctcttagaaatgtcttgatctacattttatgtaatttgggtcagaagaaaatccctttaggaactaaagggcgcattatcccagatattcaattatccgaggaaattcttaaatattgctgatattaaaggctttcaaagaaatatcctcggataatgtaatggctatttcagaaaatcaggcaactgattttccttctgattagcaggggtttccttttgatgtgaaaaccatttctcgttccaatctcggatatacctgttcacggtactctgggaaagctctgcgtaccgttcagtcgtagaaatcgaggaatgtccgagaaagtttttgattgctatgatcgggactccggcttctaacatatgtgtggcggttgtatgtctcatggtatgcggggtataacacttttcaagaaacatcttcggatactccgccttggcaagggcaacatattttttataaatttcctcaatgcaggagatagtcatctgcggatgtgtctggctggaaaagatataggcatctaaccgtccagttctgcctgtttcttccagataccgtttcaggaggattccgctaggtttagcgattacaatcctgcgggtcttattcccttttcctgtgattgtcagcttgtacagatttttttcaacaaggaaatctctgactttaagatcacagatttcctgtgccctggctccgcttgcatacatcaggtttaaaagaacctggtcacggaagcccaagcgtttttcagtgtcaggaagccggagcagggctgacacttcatcaagcgaaaaaataatccttggctggctggatgccttttttacaggaatcctccttacagcattcgcaaacacagtcgccgcttcaaaatttctgttctgtgcgtaagcggcaaaggatgtgagtgccgaaagccggaggttccttgtggataccgagcagccccgttctgtttcgatccatttcaggaaactgtcgattgtttcaaaatcgagatcctgaaacacgatttctccggcatctttctttttcacttgataaacatactggaacagaagccgaaaagaatgcttatacgatcggacggtgttaggagaaagacctgatgagagcggcatatattccgtaaaaaactgttccagcagaagcatgaagtcgggaagtttatttttcctcatcgcccacctccatgaatacgctgacagcatagtcttcaaacaattccgtgtattcggggaacatgtcgctgctgaatttcaggtacttctcagtctcgttcatgtcatggtgtccaagataaacggacaggaacggtacagaatcatttaccggacgtccttttttctctgcctgtacaaaagaatggatggcaaagtaatgacggaaacaatgaagacattgacctctggaatgagcctttccaggtacacacaggttggtttgctgtaacagcttcctgaaccgtaatccgaaagttccttttgtaacagctgccccttttttcctgaccgatggaaacaggtggctttccggctctgttttgattgccatcgcaatgcagtacttttccagcattctggttaatgttacatccatcggaacgacacgctgcttgttattcttggcatggcggatcaggatagttccgcgggaaaagtttatatccttcaccctggcagcaagtggttcccccaaccggaatccgcagcccaaaagcatccgcagtaacatacagaactccatgtccatctgtcgcgtttgcgggtctgtgtgcctactgccccagctatcggcactggccagaagcatttgtatttcctcatccgaaaaaatatatgggacatagctgtctgatgttttagggcagtcaggcataaaaacactgtagccttcatactggagataccttaaaaatttccggagatagctcaccttgtcgctgactgttttaggtgcgttagtctggagaagtctgccaatccaacgattcactgtcctttctgagatttcgccggtattttcttctgccagcagtgagtcgaacgaaagcaggattctgcgtgtattctgtaaagtaccgtcactgattgtgccctggctgattgcaaggtattccgccagctcgtttttgaaaatgcttttaaattcattcatgacaaagaccaccttccttccagaaaaccggcaaatgtacctgctgcttccggtacagggagtgcgtagccccgaagctgctcaatgtccagactggcataagaacggatggcattttggtctgtatgtccaagagtttttcttacgacttcataagggatgttgtcattgaccatggaacttgcaagggatgcccggaaggcatgtgctccctgcttgcgtttacctggatcgattcctgctgtttcaatggcagtccttacaatcttagtgattgcctgtactgagatatggctgtaaggcggaataattcggagaaacacatatggactttcattgtcggcacgctcttcctgtaaatatctctccaaagcagtttttacatcgggaaccatgggaagttcaatagtgacactggttttatgctgggtaagcaggatcaggtccctgtcaaaatccagctctttgaatgtcatggatgaaatgtccccgcttctgattccgagccgcgtcgcaaggagcagggctgcataatcacgctttccgtgtggggaagtctggtctatgctgctttcgatttttagaatttcatctgttgtgtatacagaagggtatggctgcggtcttttaaaaagagggacaataccactgtaatccctgtcggtatgaccggactgataagcataccggagaaatgtccggatgtgggaaagataccacttgctgctgactgataagcatacggttcctatattttggggattcatttcctgcggtttcacacaaccgattctggttagggcggataaaaagtaatgtccaatcttatcatgaagatgaattgtactttcctgtagccccttacgtcgtccgtcttcaagatattccgacaaaaaagcatccatctcgggattcagttcctgatacctgcatgatgcaatgtcgttttcgtttgtctgttgacacatggttaaaacctcctcgttattttagtggctttaactgtaccatacatgaaaaacgttatccgagattttctgttcaaaacccagaataccaaacgacatttgaagtttacctcggataattgaatatctgggataatgcgccctatcccagaactcggatagggcgcacttctatactctctgtcgagagtagtgcgtcctgcggagcttcattctctgtcagcagaagaaaactgcctgacctcgaatgtttccgtcacttcgtttcgacaaggtggctacacccccttgcgccgcttatgcggctatcccctgtggacttgccgtccgcaaacagcatgaaatgctgttcgccgccagcaagtttgattttgaaaatccaactaaaaggagaagcataattatgaaacggaaattggtaatgttactaactattgtagcggttctcgcagtagggattggtatctggtacaatgttcctattaacttgatggatttggaacatgatgaagttatagaaattgtcgtattcaatggaaatactggaaatgcaactcacatcacagatgagacacaaatcgaacatattattgaaaatctaaatgaaatcaagttaaaaaggtcgaagccgtctgttggttattctggatatagctttaagatgaccatttatttatccgatggtaatgaagccgatgattggaataactttatcatcaattccgatgatactattcggaaagaccctttcttttacaaggtggtttcagaaaaaattgattatgattatatagctggtatcgtaaactaaagtgagataatcattgcaactgaatactaaaaaacagaccgttgatacacatgaccgtgtgaaaaaatcagcggtctttttttatacccattttcaaaaaaggaggtcatgaaacatggcaaaaacgaaaaccctcgaccagcttagagccgaaaaagaacaagctgaagctcagcttcttcaggaacagcacaagctccaaaggctggaacagaggaagaaacactatgagaaaggcgaacgcaagaaacgcacccaccgcctttgcaatctgggcggcatggtggaaagcgttgccccggaggttaaggacttgacacgcaccgaaatgacagagctgatggaacacatcttttctctgtccgaagtccagcgagccgtccgtcacatggcgattacccacatcaacaaagcgaacggaggaaaggagttgaaagccgatggcactatttcatctgagtgtcacgcagactaagcgaagcgcaggacagtccgctatcgcttctgctgcctaccgagccggggagcgattgtatagcgagtattacggcgaatacagcgactacacccgcaagggcggcgtgatctgctctgacattctcttgccgtcccatgctcccccggaatttgcagaccgtcagaccttgtggaacgccgtggaaaaagccgagcgtggtaagaacgcccagcttgcatacagctttgacattgccttgcagaatgaattttcccttgaggaaaacatcgctcttgcaaggcaatttttattggagaactttgtgagccgtggcatggtggttgacttcgccgtacaccagccagaccgggaggacggcggcataccaaacccacattttcatgtgctttgccctatccgccccatcgagcagaacggcaaatggggactaaagcaacgccgggtgtatgagctggacgaggacggcaaccgtatccgagacgcagacggaaagtttgtgttcaacgccgttcccactaccgactggggcagtcccgaaacgctggaatactggcggcagacatgggcggagctatgcaatgccaagtttgcggaaaaaggtattgatgttcgtatcgaccaccggagctatgagcgtcagggcgtggagcttcttcccaccgtccacgagggcgcaaccgtccgggcaatggagaagaaaggcatacgcaccgagaaaggcgagttcaaccgctggatcaaagccaccaatgccgttatccgtgacatcaagaagaaaatcgctctcctgttcgattggattgccgaagcaaaagcggagcttgccaagccgcaggcacccgaccttgtttcgctgctgagcgcctattacacccagcgcagagccggggcatattcgcagaaaggcaaggtcagcaatctaaaggagatgaacgagactttcaattatctccgggcaaacggcatttactcccttgaagatttggaaagccgtgtcagcgaacacagtgctgccacagagagcttgaagaaaacgctggacgaacagaccgcccgaatgaaagcaattaagcagctctatgacagctccgctgctttccagagcttgaagcctgtctatgacggcttgcagaaaatcaagtttgagaagcccagagccaagtacaaggcagagcatgaagcggaactgaaacagttctacgccgccagacgcaagctgaccggagagttcccggacggcaaggtggatatgaaaaagctgaccgaagagtatgacgagctggaacaggcgcacaacaccacctatggcgagtttaagaccgtcagagacgatttacaccgtctttggaaggtcaagtcatgtgtagatactgccgcccgatttaacgagcgtacagaggaacaaatgcaccaaaatcgaccccaaacacgacacaaaaaggaggatatatcccgatgaattacacccaagcacagattgaccgggcgaacgccgtcagtctggaagattttctccgcacacagggagagacacttatcaaaagcggacgagaataccgctggaaagaacatgacagcctgaccgtccggggaaacaagtggtttcgccacagccagagcaagggcggctatcccattgatttcgtcatggagttttacggcaagtcctttcccgaagctgtccagatgttgacaggcgaaaacggcgagggacagaccgaagccaccacagcaccgcccacagcgttccacttgcccttgcacaacagaacagccgacagagcaattcaatatctttgcgaaagccgaggtctcaacaaaacgcttgttgagacttttcttctttccggggatatttacgaggacgcaaagcggcacaatgttgtgtttgtcggcagagaccgaagtggtacgccgagatacgcccatgtgcgaggaacggcagacccattcagacaggacattgccggggctgacaagtcctatccgttccgctatgagggaaacggcaatcagctctttgtctttgaagcaccgattgacctgttatcattcatctgcctttatccgcaggactggcagacaaggagctaccttgccctgggcggcgtttcaggcaaagcccttgaccgttttctttctgaacgcaaggacacccgaaaagtgttcctctgccttgacagcgacaccgcaggaagtgaagcctgcacccggctggcacagtccattcccggcgagatcgccgtcattcgccttgtcccggcaaggaaagactggaacgatgttctccgtcagcaaggggacattcccagccgcaaattcatagccgagacaatcacgctgcgagagctgcccaccgcccagcctgttcccatgctccgcatggcagatgtggagctgacgagcgtggattggctatggtttccctatatcccctttggaaagctgacgattatacagggcaaccccggcgagggcaagacctactttgccatgcgtcttgcggcggcttgtaccaaccgaaagcctttacccggtatggagacccttgagcctttcaacatcatctaccagaccgcagaggacggtctgggcgataccgtcaagccccgactgatggaagcggaagcagaccttgaaagagtgcttgtcattgacgatagggacacaccgctgacccttgccgatgagcgcatagcaagggcaatccgggaaaacaacgcaaggctggttatcattgacccggtgcaggcgtttctgggcgcagatgtggacatgaaccgggcaaatgaagtccgtcccattttccgcagtctgggagatattgcacaggctactgggtgcgctatcgtgctgataggacacctgaacaaagccgcaggaacacaaagcacttacaggggcttagggtctatcgacattacggcggcagtccgcagtctgctctttatcggcaagctgaaggacagccccacaacgagggtgcttatccatgagaaaagctcccttgcgccgcccggacagtcccttgccttttctctgggagacgagaaaggctttgaatggataggagcttatgacattaccgctgacgagcttcttgccggggcagacaacaccaagaccgagagcaagaccgcacaagcgcaaatgctcattctggaactgcttgcggacggaaagcgtatgccgagcgcagagctggaaaaggcagtcaatgagcgtgggatttcctcacgcaccatgagaacggcaaagagccgtatcggggacagacttgtgaccgagaaagacggcacagcatgggtctgctatctccgagactgacaacaggaacacggcaagcgtggcaaagacggcaagggttttatagataccttaatgttgccgccttgccttgttccctcatactgacaccgcccgatgatgaacagttaccgggcactttttcatttacaggaggattttgaatgaacaatactgcaaccaacaccgccacttgcccgactgtcagaaagcagattggcaagaccacctatatcgtccgtgtccatttcagcgagaccgccaaggagacgatggaggacaaaatcaagcgtatgctccgtgaagaagtccgcaaaatgtgacttctttttgaatttgatgaaaaagtccttgacttttcgtctctggcaagaccctgaaatccatcctcattagctgcggcgcccgccttgctcccttcgatattgcggagctgcgggagatcatgtccgacgacgaactggagctggataccctgggcgaccggaaaacggcgctgttcctcattatgagcgacacggataccaccttcaacttcgtcatcgccatgctgcaaagccagctattcaatctcctttgcgacaaggcggacgatgtgtacggcggcaggctgcccgtccatgtgcggtgcctcctggacgagtttgccaacatcgggcagatacccaacttcgacaaactgatcgccaccatccggagccgggaaatctcggcttctattattttgcagtcccaaagccagttaaagaccatctacaaggacgccgcagataccattgtgggcaactgcgacaccaccttgtttttgggaggcaaggagaaatccaccctgaaagaaatctcggagctgctgggcaaggagaccatcgacagcttcaatcaatccgagaaccggggcagccaggtttcccacggcctcaattatcagaaattaggaaaggagctgatgactcaggacgaaattgcggtgatggacggaggcaagtgcatcttgcagcttcgaggggtgcggccatttttcagcgacaagtttgatataacgaagcatccccgctacaagtaccttgccgacgccgacaagaaaaacacctttgacattgaacggtacatgaaacgcagaccggccatcgtgaagccggacgagcctttcgatctgtacgaattgaaagcgaccgaccttcaacccaacaattcaactgaacgaaaggaaatgtgaatatgagcttttttactaacgctatcgacgttttgcagactctggtcatcgccctgggcggcggtctgtgcgtgtggggcggcatcaaccttctggaaggttacggccaggacaaccctgcctccaatgctcatgtacggtagagaagcacaaagcaaaacaaggatagccagccctgccactattccgaagtcaggggaacgcaatagaaaaatttatagctgtatgctatacttaattagcatttgaacatatcaagctgacacagcaatctctttacttgccgttaatgcgcgtctaccaatagtccgcacaaagcaagagtagcgtaaaggtataaaaatttcaaacttctttgtaacgaaattccgatttctccgtctaacctatgaagctgaaggaggtgatgacaagtatggactatgaaaagctctataaagcctactatttacaggtatactcgtatactatttctcttgccaaaaatcgtgagatagcagaggaaatcacgcagaacacattctataaggctgtttctacaacatcacaattcaaaggtaagtcagatgaattgacatggctctgctccatagcaaaaaacctttaccatgatgaaatgcgaagccgtcagcgagtagctaatgtgagtgaaatcaatgacttgccatcaaatgaaaatgttgagaactcagttgcagattctgacatggcgttccgcatacacctcgttcttcaccgtttggaagaaccatacaaagaagtctttcaacttcgcgtattcggggaactatctttttcacaaatcgctgcaatttttggaaaaacagaatcatgggcgagagttacttatcatcgtgcaaagctaaaaattcaagaaaggatggatgaaaagcatgagtaaacaatgcgatattgttcgagatattcttccgctgtatgttgacggtgcttgcagcgaagcaagcgcagagatggtaaaagagcatttgaacgcctgtgctgactgtaacgcaatttatcagaaattgctttctcacacgagcgaagatgttcttcacgaagaaagcgaaagcgttattatgcgccatgaggcaaaagaaaagcagagaggcagaaaaaagataacgattgctgttctcgtttccatcgctctttgtatcattgcaatttttacagctctctttctgttacctataaacattgcttatgagcctgtcaaaatcgacttcccatttgaggttgaagatgtcgaaaacgttgaaatgtaccactatgacggagtgcctgcatcagcagaaaagaaagtagttgttgctgaaaatgatataaagaccctgtatgataagttcaagggcttatccctaaaagacaaaacgactgaggaaactgccggagcagatgtgaccagttttagatttaacctctcagatggaacaagctacgatttgatttacgcctgctatggagttaaaaacggcgaattaaagtcagaagcaggcggttttaagtattttacaagtgcggatattggctcttattggaacaatttgaatacggaacttgaagcaattcctatcaatgagagtgaattgccgtgagcagatagcaaacccagccgagcctgtcaacggtcaagatgaacggcgcaaatgcgccgccgttgacagccccgcccgtctttgctgttcggtaatcaagagggcgacagcataaaatgctgccgccctctgccattattcagaaaggggggattttccatgaccgaacacgaaaagtatcaagaacatatccggcatacacacgatgccttttgcaagaccgttattcgccacgctgccatagacgcagcccggagcatacgcagccgccgcaagcgggaaatctcgcttgaatatctgatagaagaaaaacactatccattcagtaccacagataaatactttgcggagcaatccggcatgaccagctatccgcttttcgtctgtggtcagatggtgcttttggaaagtccagagcttgccgcagcgctgtccgcactatcacagatggaacaggaaatcattttcctgtactacttccaacgattgacgcatagggagattggacggagatatggacgggctggcaacacaaccgggcggcgtattcagatgattttacggcggctacgggcagagttggagggcttgtcctatgaaccagctacttccctatgagacaatcgttaaggcaagcgagggcgacccggaagctgttgccgccgtcctatcccattatgcgggatatatccgctcttgtgcgaaaatggacggacagattaacacggatatgcaggagcatatcgtcaggcaactgatagaaagcctgttgaagttccgctttgaccgctaaacagaaaagttgtataattagagcctgacaaattaaacttcaatgagggtagagcaaatggaacagattatcaattatagagacatacccacaaataaaaggattgacatattaaatgctcttgagcgaataggtttttttccggcatacggcggcgtgaaaacaatgcagcaaattatggaaaagtcagttccaggttcaggcccacaattttatttcgttttccgtgaaaatgagttgatagggtacaattttctcattggggacactaagaaatataaagcgttcccatggcttgctattagcaatatggatgagcagaagttgactgtttgtgaagaactgatgaaaatacaaattgccttttttgaagaactcggaatgcaaaagatagcagatcattgcgttaggattatggaagattacagaaaaggaattggaaagcagaaagaaagcgattgcagataaattccatttgaaaaacggctgacaatttaataccgccgcccatcacagcggcagataagcagtaaatcttgaaaaggtttactgctttttttgcgcccattttcaaaaatctttggcaaaccacaccgccggattgttgtagggagcagacagggaaaacaaaaaatttccgctgcgtttgccaaaacgcccccttttcaccgttgtagtggtgaacagcgggcagaacacgccgccgcaatcgctatattggtggagcaagccagtatatccgcaaaccagagccgccgaggaaagcggtagttttttagagccagagccgccgaggaaagcggtagttttttagagcaagattctaccgcagtaccaaaattcgcttatcgctcattttgcccctgcgggaatcttgttggggagtgccttccccaaaccctgccatgcggcttacgccgcttatcccgccgcagccatgcggcagtcgaaaggaggttttaccatgcgaaaacgatacaacacaccgcaccgcagccgggtagtcaaaacacgcatgaccgaggaagaatacgccgagtttgcagaaaggctttctgcctacaacatgagccaagccgagtttatccggcaagccataaccggggcagccatacgccccatcataaccgtttctcccgtcaatgatgagctgcttgccgctgttgggaagctgaccgccgaatacggcaggatcggcggcaacttaaaccagatagcccggacgctgaacgagtggcacagcccctacccgcagcttgccggggaggtacgggcggcggtttccgaccttgctgccctaaagtttgaagtcttgcagaaagtgggtgacgctgttggcaacattcaaacatatcagctctaaaaatgcggactatggcgcagcggaagcctacctcacatttgagcatgacgagtttaccatgaagcccacccttgatgaaaacgggcggctgataccgagggaggattaccgcatttcttcccttaactgcgggggcgaggatttcgctgttgcctgtatgcgggctaatctccgctatgagaaaaaccaaaaacgggaagatgtgaaaagccaccactatatcatcagctttgacccacgggacgggacagacaacggcttgaccacagaccgggcgcaggaactgggggaacagttctgcaaggcacatttccccggacaccaagccctaatctgcacccacccggacgggcataaccacagcgggaatatccatgtgcatatcgtcatcaactccctgcggatttacgaagtcccgcttctgccctacatggacagaccagccgacacaagggagggctgcaagcaccgctgtaccaatgccgctatggaatatttcaagagtgaagtcatggagatgtgccaccgggaagggctttaccaaatcgacctcctaaacggcagcaaggaacggataacggaacgggaatactgggcggcaaagaaagggcagcttgcccttgataaagagaacgctgtcagagaagccgcaggacagccgaccaagcccaccaagtttgaaacggacaaggcgaagctgcgccggacgatacggcaggcactttcccaagctggcagctttgatgagttttcttcccttttgctgcgggagggcgtgaccgtcaaggagagccgggggcggttttcctacctcacgccggacaggacaaagcctatcacagcccggaagctgggggacaattttgacaaggctgctgtccttgccctgctcacgcagaacgcccacaaagccaccgagcagaccaaagccatacccgaataccttgtcgcagttaaaaagccgtcacaaggggaaaaacccacaaaaactaccccggcagacaacaccttgcagcgcatggttgaccgggaagccaagcgagccgagggcaagggcgtgggctatgaccgctgggcggcaaagcacaatctaaagcaaatggcaactaccgttaccgcctaccagcagtacggcttttcttccccggaggaactggacgaagcctgttctgccgcctatgccgccatgcgggaaagccttacagagctgaagcaggtggaaaagacgctgaacgggaaaaaggagctgcaacggcaggtgcttgcctattccaagacccgccctgtccgggacgggctgaaacagcagaaaaacgccaaagcaaaagcagcctaccgtcagaagcacgaaagcgactttatcatagcagacgcagccgcccgttatttcagggagaacggcatttccaagctgccgagctataaagccctgcaagcagagattgaaagccttatcaaagagaaaaacagcggctacaacgattaccgggcaaaacgggaggaataccgccgcttacagaccgtcaagggcaatatcgaccagattttacgccgggaacgcaagcctgtgaaaaggcaggaacaggagcgataaaaaccaccccaaaatgtacccgaacccatacagaacaagggggctgccccgtaccctatccgcaataccaaaggattttttaacgggcttacagggcagaaaaaccccgaaaatgataccgagataatacagaattaccgccgataccgccacaccagcggaaacggcagaaaggagcgcacccatgccaagaatgagcaagaaacggcggctggaatggtcttttttcctgcggcaagtaaaaatcgggaataccacctgcgaccgtatcacatacaacgacctctgccggagctgtacccatagctgcaagcagagcttccgggcggttatcatactctgcccccgctactactccaaacgccggaaaaaggaggacagggacaatggcagataaccgcaagtattactacctcaagctgaaagagaacttttttgacagcgactccattgtactgctggaagatatgaaagacgggattttatattccaatattctcttgaagctgtacttaaaatcgctgaaaaacggcgggaagttgcagcttgacgagcatatcccctacacagcgcagatgatagcgacactgacccgccaccagatagggacagttgagagggctttagagattttccggcagttggggcttgtggagcagcttgacagcggggctttctatatgaccgacattgagctgatgataggacagtcctctaccgaagccgagcgaaaacgggctgcaaggctggaaaacaaggcacttttaccgccccggacaaaaggcggacatttgtccgacattcgtccaccagagaaagagatagagttagagaaagagatagagatagaaaaagagagagagggagaaacgggacaccccgcccccgccgcttatggcagatacaacaatgtgatactgaccgatacagagctttccgggctgaaaacagagctgcccgacaagtgggagtattatattgaccggctttcctgccatatcgcttccaccgggaagcagtaccacagccatgcagccaccatttacaagtgggcgcaggaggacactgccaaaggcaaggctgccccgaaacagggcatacccgattattcatgcaaggagggcgagagcttatgaaaaacgagatggaagctatgattacggacattacagccactaccgccgaagcggaggactacacaggcgaggacgggcttttatactgcggcaagtgccatacgcccaaagaagcctactttgcagagggaaagacctgtttcgggcgtgaccgccacccaacagactgcgactgccagcgagcagcccgtgaaaagcagcaagccgccgaaagccgacagaagcaccttgaaaaagtggaggacttgaaacgccggggctttaccgaccctgctatgcggaactggacatttgagcatgacaacggcagaaacccgcagaccgaaaccgcccgcttttatgtggatagctgggaaaccatgcaggctgaaaatatcggctacctgttctggggcggcgtggggacaggaaaaagctaccttgccgcctgtatcgccaacgcccttatggaaaaagaggttgccgtctgcatgacaaactttgcaaccatactcaatgaccttgccgccagctttgagggcaggaacgaatatatttcccgcctttgcagctaccctctgctgatacttgatgatttcggtatggagcgagggacggaatacgggctggaacaggtttacagcgtgattgacagccgttaccgaagcggcaagccgctgatcgctacgaccaacctcacgctggaggaattgcagcacccgcaggacacgccccacgcccgtatctatgacaggctgacttccatgtgcgcccccgtccgcttcacgggcagcaacttccgaaaggaaaccgcacaggaaaagctggaacgattaaagcaactgatgaagcagcgaaaggagagcctatgacagaaaccaaacagacaagcaccaccaaaacagaccgccgcccggactgtgtgacggaaatccgcatgggcaactccgtccttaccgtttccggcttcttcaagcagggtgcaaccgacaccgcagccgacaagatgatgaaagtgctggaagcggaagctgctacacaaaaaacggcgatttgaccgaccataaagaagcagatttgacgcttttgccgctatacagacagccgccccatgtggtacaatcaaggtacggaatagtggggctggctgtcggaaacggaggattttatgttaagacagaccacccagaaaatcactgccctttatccaagactatcccatgaggacgagctgcaaggcgaaagcaattccatttccaaccagaagcgtattcttgaaacctacgcaaagcagaacggtttttccaatctgcgctggtacacggacgatggctattctggtgcgaacttccaaagaccgggttttcaatccatgcttgcggacattgaagccgggaaagtggctaccgttatcgtaaaggatatgtcgaggttagggcgaaactacctgcaagtgggaatgtacacggaaatgattttcccacagaaaggtgtccgcttcatcgctatcaatgacggagtggacagcgcacagggcgacaatgactttgccccgctgcggaatatctttaacgaatggctggtgagagatacgagcaagaaaatcaaagcagtaaaacgctcaaaaggcatgagtggcaagcccatcacaagcaagcctgtgtatggctacctcatggacgaggacgaaaatttcattattgacgaggaagccgcacccgtagtcaagcagatatacaacctctgccttgccgggaatggtccgaccaagatagcccgtatgctcacagagcagcaaatccccacgccggggacgctggaataccgcaggacgggcagcacacgccgctatcaccccggctatgaatgcaaatgggcgacaaatactgtggtgcatatccttgaaaatcgggagtacatgggctgtctggtgaacttcaagacggagaaaccgtcctacaagaccaaacacagcgtagaaaatcccattgagaaacaggcaattttcgagaaccaccatgagcctatcattgacacccagacatgggagcgtgtgcaggaattacgcaaacagcgcaagcgtccgaaccgctatgatgaagtgggcttgttctccggcatactgttctgtgcggactgcggcagtgtcatgtatcagcagcgataccagacggacaagcgcaagcaggactgttatatctgcggcaactacaagaaacgcacccatgactgtacggcgcactttatccgcaccgacctcttgaccgctggcgtactctccaatctgcggaaagtgacaagctatgcggcaaagcatgaagctcggtttatgaagctcttgattgagcagaacgaggacgggggcaagcgcaggaacgccgctaagaaaaaggaactggaagccgccgagaaacgcatagccgagttatccgctatcttcaagcggctgtatgaggacagcgtgaccgggcgcatatcagacgagcgtttcacagagctgtcggcagactatgaagcagaacaacgggagctgaaagaaagagccgctgctatccaagcggagctttccaaagcacaggaagccaccgtgaacgcagaaaagtttatgaatgttgtccggcggcataccagctttgaagaacttacccctactctgttgcgggagtttgtagagaaaatcgttgtgcatgagtgcagctatgacgagaacaagacccgtaggcaggacattgagatttattattcttttgttggcaaggtggacttgcccgaataaccgcccgacctatccgacatacctcatgtgccggataggaacggcaaaattttttacacttctattacttctttatcacacatcagtaaagagccagggcatcaagcagctcatggcgggcggcggcgttgccctcatcggcatcaccctgatccctctgctgtccggtctgctgtccaccacctaatgtttctccaaaaccggtgggggctttcgcttgatagcgggagcccccgcaaaggaggtgatctcccttgatattggatatgatccaggagtggttcaaggaactgctcattgacggtatcatttcaaacctgaccgggatgtttgataccctgaacacaaaggtgggcgagatcgccggggaggtcggcatgacacccgccgcctggaacagcagcatcttcaacatgatccgcaacctctcggagacggtgatcgtccccatcgcgggcatcatcctcaccttcgtcatgtgctacgagctgatccagctcatcatcgagaagaacaacctccacgacttcgacacctggattttcttcaagtggattttcaagaccttctgcgcggtgttgatcgtcaccaacatctggaacatcgtcatggcggtgttcgatgtggcgcagaatgtggtcagtcagtcggcgggggtcatcatctcggatgcgggcatcgacatctctggcgtggtgggcgatctggaaacccagcttgccgactggagcgtgggcgccctgctggggctgtggttccagagcgtgtttgtggggctgtgtacgcagatactttccatctgcatcttcctggtgatctacggcagaatgattgaggtgtatttggtgacctccataggccccatcccctttgccacgatggtcaaccgggaatggggctccacggggcagaactaccttcgctccctgctggccctgggcttccaggccttcctcattatgatttgcgtgggcatctacgcagtgctggtggagggcatctccacatccggcgacaacatatccgcggccatctggggctgcatgggctatacggttctactgtgctacaccctgttcaagaccggcagccttgcaaaatccctgttcggcgcccactaaaggaggtgtaaaacattggcttatgtaacgatcccgaaggacctgagccggatacagagcaaggttctgttcgggctgaccaaacgacaagtgatctgtttcggagcggcggcgctggtaggtgtgccgcttttctttttggcaaaagcgagcctggggaccaccacggcggcgctgtgcatgatcctggtgatgctgccctttttcctgttcgccatgtacgagaagaacgggcagccgctggaagtatttctgggccatctgatccagaacaaattcatccggccgaaggtgcgtatctaccagaccaacaatctctattccgccctggtgcggcaatcccaactggaacaggaggtgaagcggattgcgagaaaaggcagaaagaccggcgaagcgtaagctcacccgtaaccagcgcaagcagatcgaggcggtgatccggcaggctaagggcgacggaaaagcccatacggtgcaggacagcatcccgtttcagaatatgttccccgacggtctgtgcagactggagggcgggaccttttccaagaccattgcctttgaggatgtgaattaccgcctggctgggccggaggaccagcggagcatctttgaaagcctctgtgacttctacaacggctacgatccctccatcggcgtccaggtcactttggacagccgcagcggaggcagcgccgccgatgaaatgttcggcattacccggcagggcaacgacctggaccccatccgggacgaggcggtggacatcctgcggatgcagtacaaacggggcaacaacggctatgtgaaaaccaagtatgtgaccctgaccatcgaggcggagaaccttcccgcagcacgggcgcggtttgcccgcatcgagaccgacaccctcaaccgctttaaggtcatgggggcggcggctcatgtgctggacggaaaggaacggctggagctgctttacaacatcctccacccggagggtgggcagttcgcctttgaatgggactggctcccggccagcggcctttcggtgaaggacttcatttcgccgtcctccttccacttcggggagacccgcaccttccgcatcggcaggcggtacggggcggtgtcctttctgcaaatcctggcgccggagatgcacgaccgcatcctcaccgacttcatggaggcggacgggaatatcatggtgaccatgcacatccggggcatcaaccagaacgaggccatcaaaatggtcaagcgaaagatcaccgacctggacgccatgaagatacaggagcagaagcgggcggtacgcagcggttacgatatggacattcttccctccgacctttccacctacggcggcgcggcaaaggaccttctcaccgacctgcaatcccgcaacgagagaatgttcaacatgacctttctggttctgcacacggcggagacccggcaaaagctggagatcgccgtgtcccaggcggccagcgtcgcccagacctacaactgtcttctgacccggttggacttccagcaggaggacgggctgatgtcttctttgcctctgggcctcaactgcatcaagattgaacggagcctgaccacttcggccctggcggtgttcgtccccttcgtcacccaggaggtgttcatgggcggcgacgccatgtactatggcctcaatgccctctccaacaacatgatcctgctggaccgcaagcaatcccgctgtcccaacggccttgtgttcggcacgcctggcagcggcaaatccatgagctgcaaacgggagatcacctttatcatgctgatgacccaggacaatgtcatcatctgcgacccggaggacgagtattcgcccctggtgaagcggctgggcggccaggtaatccggctgtccccgtccagcaccgactatgtaaatcccctggacatcaacctcaactattccgaggaagaaaacccgctggcgctgaaatccgacttcgtgctgtccttctgcgagctcatcatgggcagcaagacggggctggaggccatcgaaaagacggtcatcgaccgggcggtgcagatgatctaccagccctactttgccgatccccgggcggagaatatgccgattttgggcgacctgatgaacgccctgctgtcccagcacatcccggaggccgaccgggttgcccaggcactggacctctatgtgaacggttcgctgaacttcttcaaccaccgcaccaccgtggacatctccaaccgccttatctgctttgacatcaagggcctgggcaagaacctgaaaaagcccggcatgctgattgtccaggatgcggtgtggaacaccgtcaccatcaaccgggccattggccggtctacctggtatttcgtggacgagttccaccttctgctgaaagaggaacagactgcggcgtacagcgccgagatttggaagcggttcagaaagtggggcggtatccccaccggggcgacccagaaccccaaagacctgctttcctctccggagattgaaaacatcctggaaaacagcgatttcatctatatgctcaaccaggcggcgggcgaccggaagatactggcggagcggctgaacatttcttctgaacagcttgcctatgtgaccaactccgagccgggccacgggctgctgttcttcaacaatgtcatcctgccctttgcggatgacttcccgaaggataccgaactttataagctgctcaccaccaagcccagcgaggtggaacatgaggaaaggatgggataaggatatggaacaggaaaagctgtatgtcattgaggaaaagacctacgaggcgcacatcgacgaggaggtccacctctacgggttgctccaccaactggcctttcttgccgggaagatcaaggaccgccgggacatggagaacctgatcgacaccgcccggcactatggggacattgccgaccagatgtttgaccgctggagcatccccggccgctatttggtgttcggcgacaaggacgaccttgcccggctgaaggccctggagctgtgcgagctggacgccttctatgtggactgcgaggacgacgaggaccagctccatgcctgaccgcctcacccatgtgagcctcttttccggtatcggcgggctggacctggcggcggaggcggcaggctttgaaacggtctgccaatgcgagtgggcggactatccctattccatcctgcaaaagcattggccggatgtgccgaaattccgggacatcaccacattcacgaaggaggcgttttttgaaagaacaggacttgaaaccgtcaccatcctctccggtggcttcccgtgccagcccttctccaccgccggaaaacggcgtggctttgcggatgaacgctacctgtggccggagatgtgccgcgttattgccgaactgcgaccccattgggtgcttggggaaaatgttgctggcttcatcaatatggggctcgacaaaacgatttttgacctggcaaaagcgggatacgctgttctcccattcgtatttccggcttgcggcgtcggcgcatggcatgagcgccagcgaacttttatcgtcgcggctgatgtttcccacaccccttgcctccgacaaatccacggggcgagacgctgccaacctggatgtgttcctgtcggacaatgggatattccgcaaacggaacaaggacgggtccatctggagcctgtccctgtcggcggcggtgttctacctgaccccggcagcgtcggaggactaccgttccaccctgaaaccggcggccttccgggacaaatccccgacctccaacctgtcggcccaggtgatccggcaggagcagcccttttccgaaaaggcggcgctgaacccggactgggtggaatggctcatgggattccccccgaaatggacggacgcatcctatggcgtgccgagcccgaaggagtcccccgcatgaccgaggacacggacaaccgggcgttgcggctgaaaaccctggggaatgcggtctgccctccccaggcctatcccattttccagtacatcgccatgatcgaaaccggggcctgtgtcaacatctgcccctatggaacaggaggtgacgcaccttgaaagaatggaaagcccccgaaaaggaggcgcagaagatgacccgtgacgggtcggtgtccgtcaatctggtcacgggcgagactacctatccctctgatcggacgccggagcaggactattccacatccggcgacgcggcgggcgccgctggaaaagcggtggaccgtgcggaactgcaccgggaacaggcagcagccaaaaagaagcgccggaaacagcgcagagcctatcgggagggcgaggcggcagcgggccgtccatcctcccgattgcagttttccgaggcggaccaggccaagccggagctgcaaggtgctatccgcaagtcggacaaggcggcggaccggctggatgccgccagagacgcgatccccaataagagtccgggaaagccccacaccaatccgctgtcccgccctattcaggaggcaggcgcggcgatccacggcaaggtccgggaggtggagcaagaaaattccggcgtccagtcgggccacctgggggaacgcagctttgagaaggctgtgggctacggaaaccgccgtgtccagaactggcgggcggaacgcaagctgaaaccctggcgagacgtagcaaaggcggagcaggcggcggtcaaggccaatgcggatttctgctatcggaaagccgtggcggagaacccccagcttgcatccaatcccatctcccgcctgtggcagaaaaggaagctgcaaaagcaatatgcggcggcatatcgggcagcgggcaagactgcccaggccgggaaaacagcggaggccacggcaaaggcggccaagaaaaccgcccaggagtccaagcgcaccgcccttttcctgaaacggcattggaagggcgcgctgatcgtgggcggcatcggccttctgctggtgatgctgctgggctccctgcaatcctgttcctccatgttcggcggcggagtgtccaacatcatggcgtcctcctatctctccgaggattccgatatgctggcggcggaagaagcctactgcgccaaagaggatgaattgcgggagtacctggatacctacgaggccacccacgactatgacgagtatcacttcgacctggatgaaattgagcacgacccctatgtgctgatctccattctgtcggcaatccatgaaggggtgttcaccatcgaccaggtacaggacgaccttcaaaacctctttgacaagcaatatatcctcaccgaaaccgtgacaacggagacccgctatcggacggaaacaaggacggacagcgagggcaatccttatacggtccaggtgccgtacacctggaccatctgcaccgtcacgctggaaaacttcgacctctcccatgtgccggtctacatgatgggcgaggaacagctttccttgtacgccacctatatgtccaccctgggcaaccgccccgacctgttcccgtcctccgggtatgtgaacaagtacatcgacaacccacctaccgcctgggagattcccgctgaatacctgacggacgagcggttcaatacccttatcaccgaggcagaaaagtatttgggctatccctatgtgtggggcggcagcagtcccagcgcttctttcgattgcagcggcttcgtcagttatgtgctgaccaacagcggcctgtgcaataccgggcggctgggcgcacaggggctctacaatatttccactccggtatccgacccccagcccggcgatctggtgttcttcgtggggacctacgatacaaccggcgtatctcatgtaggcatctatgtgggcgacgggatgatgctgcactgcggcgcccccatccagtattccaacctgaatacaagttactggcagtcccatttctacgcatacggcagaccgccgtacaactgatggaggtgatgaagtatcaatatggtttcctatgggggcggcgccaacagcaccgcccttctgatcgggctgcaccagcaccgtatcccggtggacctgatcctctttgcggatacgggggcagagcatccccacacctacgcctatctggaggtgatggattcctggctgaaggatcacgggatgccgtccattaccagagtatataagaccacccgtgagggtaaacggctgacgctggaagatgaatgtttgcaaagttgcagccttccgtctatcgcctacggcttcaagcggtgttccctgaaacacaagatcgggccgcaggaaaagttctgcaaccattacccgccatgccgccgaatatgggaggcgggcaagcgggtggtcaaatttattggctacgacgcgggcgagggctaccgcagcaataaggtgctgctgggggacttggccgaccgaaaatacagcaagtggtatcccctgatggaatggggatggacgcgggacgattgcatccggcagatcgaggcggcagggctgccccagccgggaaaatcgtcctgttttttctgccccagcatgaaacccgacgagatcaccgccctgcgggagcagtatcacgatttattccgccgcgccctggcgctggaggacaacgcccggcaaaatctgaaaacggtcaagggcctggggcggaactattcctggagagaacgatttggaaaggagttttgcacacatggcaacggttgagaagatccgcaaggacatcgaaaagacgaaggagaagatctccgcccagcagaagcgccttcgggagctggaggcgcagctcaccgaggaagaaaacctggagatcgtccgcatggtcaaggcggtgcgcatggacaacaaggagctgaccgcctttctgaaagcctacgccagcggccttatcaccctgcccgacgggatgatggaggcggaggcggcgccggaccccgacgacgaggatatggaaggaatggaggacggcgaagatgaagcgtaacagagttttccgccttttggcgtccctgacggcggtggtcctgtgcatgaccgccttctccgtcaccgcctttgcgggcggtggggatggcgactattacaccggggaacccgccgagacgaccccggaacccaccgaggaacccgccaccggaggcatggagccggaggaccagccccttaccccggagggcaacgccacgctggtggacgattattacggcgataagcagcttatcaccgtgaccacgaaagcgggcaactatttttacatcttaatcgaccgggcaaacaaggacaaggagatcgccgttcacttcttgaaccaggtggacgaagccgacctgatggcgctgatggaagatgggcagacggaggaacaacccgcagtctgcacctgcgtcgagaaatgccaggccggtgcggtgaataccgcctgtccggtctgcgcggtgaatatgagcgagtgcgccggaaaagcgccggaggtggagccggagcctgaaccggaaccggagaaggagtccggcagcggcggcgccctggtactgatcctgctgctggcggtcctgggcggcggcggagccttcgcctacatcaagttcatcaagcccaaacagggcgcaaaggtcagcgccgacccggacgattatgagttcgaggacgaggaatatgaaaacgaggacgttcctgaacaggaagaacaggaggaccagaattgagcaaattggtgatctgtgaaaaaccgagtgtagcaaagagtatcgcatcggccctgggtgtcacatccagggccgatggctattttgaaggcggcggctggctgatttcttggtgcattggtcatctggtgggactggcggacgcggccgcctacgatgaccgctataagaagtggcggtatgaggaccttcccatcctgcccgcccccttccgctatgtggtgtccgaggaaaaggctgaccagttccacattctccgttccctgatggaacgccctgatgtgacggaactggtcaacgcctgcgacgcggggcgcgaaggtgagctgattttccggctggtctatgaggctaccggatgttccaagcctttctcccgcctctggatttcttcgatggaggacgtggcgattcgggagggctttgccgacctgcgccccggcaaggactatgacccgctgtatcaatcggcactttgccgccaaaaggcggactggcttgttggtatcaatgcctcacggctcttttcggtgttgtatcatcgaacgttaaatattgggcgggtgcagacgcccaccctggcgatgctggccgaccgggacagcaagattgtcctgttccgcaaggagaaataccaccatgtgcggctggcgctggagagcgccgaggcggtcagcgaccgcattgtttccccggaggacgcccagaccatccgggatgcctgcgatggtaaaaaagcaacctgtgtatccgtggcgcaggagaaaaagacggagaaaccgcccaaactgtacgacctgaccaccttgcagcgggaggccaaccgggtgtttggctacacggccaagcaaaccctggactacgcccaatccctctatgaaaagaaactgctgacctatccccgcacggacagccggtatctgaccggcgacatggcggagaccgcctccgtggtcctgcatctggcggcgcgggtgcctcccttcgacgcctgcccagagtttttccccgatgttctggcgctgctgaacgacaaggaggtatccgaccaccacgccctgattcccaccctggagctggaaaaggaggatgtccctgcgctgcctgtgggcgagcgcaatatccttctgctggtctgctgcaagctgctgtgtgccgcagcggagcctttcgtgtatgaggcggtcacggctatctttgactgcggcggacataccttcacgaccaaaggaaaacaggtgctttcccagggctggcgggctatccaggaggtgttccgttcctccctgaaggagaagccggaggatgaagatgccgagggtgttcttcccgccttgaccgaggggcaggtttttgagccggtcgccgcctccgtcactgagcacttcacttcgccccccaagccctacaccgaggatacccttctgtcggccatggagaacgcaggcaaggaagatatgccggacgaggcagaacgcaagggcctgggcaccccggcgaccagggcggccatcatcgaaaagctggtgtccggcggatttgtcgagcgcaagggcaagaacctaatccccacaaaggcaggcgtcaacctggtcacggtgctgccggaactgctgacctctcccaaactcacagcggattgggagcagcggttgaacgaggtggcaaagggtcaggcggcgtcggaggctttcatggacgggatcgaggcgatgacggcggagctggtgcggaaatactcccacatttccgaggatgggcaaaagctgttccagccggagaaggagacggtggggctctgcccccgctgcggtaagccggtttatgagggtaagaagaacttcgcctgttcggaccgtgcctgtcagtttgtcatgtggaagaatgaccgctttttcgagcagcgcggaaaggtctttacttccaaaattgccactgcattgctcaaagacggaaagacaaaggtcaagggactgcgctccctgcgtactgggaaaacctatgacgggacaatcgttctggccgacaccggcgggaagtatgtgaattaccgcattgagaaataagtatcgtgtcgttcttccttcacggctctatccaagagtaacgatttgctgtataataaggccaaaatctttcaggaggtaaatagccgtgagggatatgatcgcatactgtgggctggactgtgagaagtgcgacgcttatcttgcaacgatcaacgacgatcaggcattgcgcgagaaaactgcaaaactatggtctgaattaaatcatgcgcccattctgccggagcatatcaactgtcaaggctgccgcgtggatggagtgaaaacggtgtattgtgaaagcctttgcggtattcgtcaatgcgcccgacaaaaaggcgtgacgacctgcggtgactgtcctgaattggaaagttgccagacagtcggcgcaattctttccaacaaccccgctgcgctggacaacctgaagggatagactacataccacaacaaaatagaagccgccagtgacggcatcaagcaggaaacctttccgggtttcctgcttttcttttacccattttcagaaaggatgatgtctttgagcaaaaccgaacctaatttcatggagcatttgaaaccgctgctccccgcaagcggtgacgcaagcgagctggaggcagcggcccaggcgcttgccggactttccctggaggatcgtgacctcctggccgctgtccaggagtcgccctatcgtctgaccaccctggagcagttccgggagtttcccgccaacgccgagtattttgtcctggagcccaacatcagcaaggtggaggatgtgggctggcgctatctggcgcagcatttggatgtccttctgcccccggagctgctggacgccattgatcccgttcccttcggcaaccacgccatgcaggaggaacaggggtgtttcaccagtaaggggtatctcaccctctccggcgacgagtgggagcacgagcgccccagggagaagcagacggagaaaaagccctccatcaaggagcggctggagcagggccggaaggaatgtgccaatcagagcaaggcgcagccccatcgggaaaagcctgcgccggaactgtaaggaggtgtcgctatgccccattatgattatgacaaagagtatccctttgccgctttcatcactaacctgggcaaatacaacgagggcgcccttgtgggtgaatgggtgaaatttcccaccacggcggaggaactgaaaaaggtctttgagcgcatcgggatcggcgcgaaggacgacttcgggcagacctatgaggaatggttcattacggactacgactgctatgtggacggcctctatgacctgctgggtgagtatgcaaacctggacgagctgaactacctggcttccaaactggatgatatgagccaggatgaatacgagcggttccaggcggccatggagatcggcgaccacacgggcagcatccaggagcttatcaatctgacggagaacctggactgttacgacatctaccctgacatccacgaccacgacgatctgggccggtattacatcgaggaactggacgccatgcaggtgccggagcatctgcgcaactacatcgactatgaggcctacggacgggacattgccctggaggaaagcggccagttcaccgacctgggctatgtgcgggacaccggggacagcttccatgagtattacgatggcgagcgcggcagcatcccggaggaataccaggtgatgaccttccaggacgacatccctgaagaagaaatttcggaatgggccatggaccttgcctacgatatggacgagtttttccggcagcacgacccgcagtatgccgccgagcacccggaggaacacgcggcgaaggaagaaatctacgaaaatctgatggccgggcgcatctccactctggacgagaagctggccgctctggggcagacccaggaggactatctgccttcggagattgagaagttcaaggacgccaccggctatgaggaatttctggatgtggacccgcaggcgattcgggaagctattgaaaacccggaccagtcccatgtggacgagatgctgtcctttgcggagcaggcaaatcgggagtatgaggcggagttgtacgggcagcaagcggcgcccaccccggatgaccgggagaccggcgaaacggtgcggactcccaggggaatcttccatgtgacggatatgagccgggaacagatggaggcggccggatacggttttcaccatgagtccgaggacgggaagtatctcatcatggccaatggcagccgtgcctttgccatccccagcggagccgcccccgaacataccgcgccggagaagctgactgttctggtggtggagcctatgaaggaaccctatgtgaaggagatcgatcccggccttcatgcgctgcaagcggaggtgggcggcgatattgccgcctcctatccctttgacgatccggtggggctggtgctgaatgatgaaggcaagctcatcggtctggacctgaaccgttccctccgggacgagcatggcgagatttacgacattgtggcgggcaccttcctggtggtgggcctggggccggagagtttcgcgtccctgcccccggacatgatccagaagtacactgagcaattcaagcggccggagctgttcgccagcatcaacgggcagatcgtatccgttcccgtggagccggaaaacccgctgcgcacggcggaaatgaccctagaggatgactacggcatgatcgacgggatcatcaacaacggccgccgtggggaggaattggagaaagcccaggccgaggcgcgcaggaccacgccggagaaaaagccttccatccgggagcggctggaggacgcaaagcgggagtgtgggtcgcgaaaaggcccggacaagcccaccccgcagaaggagcccccggagctgggcgacttatgagccggagcaagaaatggcgtctggaatgggcgttcttcctgggcgagaacggcaggcgtcagtataacaagctctgcaaaggctgcgcccatccctgcaagcagagtttccggacagtagtagtgtcctgcccgtactatctttcccgccgttccaaaaaacgcaggaattagggttcaaaataggcgaagaaaccgcctgtggcggcttttctgtgtaggggcagtatgatttcccatgtggggcggtaaggcatttctgcacagggaaaacgttcgtatttcacctttttcaaacagaaaggctcgctgccatcggatgttgtccggtggcggcgagcccttttttatattttgattcttggctgaactttgtcccgttctctttccacagctttcaattttacattattacgtaattggttgtacaaatcgatgttttcttcagactcatatgcaaaagttacgcataatgcataagattgaggctgctcttgttgagcatatttaaaccgctctttgcccgatattaatatgtatatatatggttcatcattaccaggccataggaggtcagcaccgcccgtaggactcttttgccaacgtctctgttgcagggttgatttctgtacagtatcataaccagggataaagtctttaattttgtattcatcaggaagcttcttaaaatcatcttctgtatctgtaccagcttctcttttggccttatatttgattagcgtatcctcatcaatcctacgaaaaatctcaatccacaaattattggctaagtattctttcctgcttattcttgttacagggttatatgccaaactaacagtaatcgattttgccgctcgaactttgagaaactgtttgggtacaggtatcttataaagatgaaaatctcgtaacggaagtctatcttctgcaaaaagtgtaacatggttatccgtcgaagtaagtatctgttctgaaattttcccatacccgtataaacgcataaatcgatcatgttttggattatcttttccagtataatctgcgtctttcgacatttcgccccaggtttgcatatcattagagcacttagctgaatttgcaagcagcgctcgaattaaatttgctgaaggccttccatcaatttgagcttccaaaatgcgttctagccgggccgcaatatgagtaacatgtggagcagcaaagcttgttccacaatatcctttaaagactcgatcattagtatggttcaaagtaggttccataagattctgatctgtctttagccaccggctggcccctctcgatatttgtcgaagtgaaaaattacctccgtaatcaacaaaatcaggcttgatagatttgttgacaccttttccgatccttgtaaataccgagggatggtcttttaaacctacagagatgggattaattccagtacctcgtaaaactgctggctcagaagaacgtgatattgatccaacggtaacgctaagagcagaagtagcaggatcaatcagacgatggtcttgagcaaatagctgatcgcgaactttttccatcgcttcttctcgggattcaaattctggtatttcaggatcggaaacatttccggcgctcacaataattacaatatctaattcccgtgctagatcatccaacatgctcgcccaactcaattggcgtccgccattatacatgctacctgcatcgcccgccgaaagattaaagatgcggcatccatacgtttcatagaaatatacaatagcatctctaacaagtctttcaggacgaacatcttctcggaaatagggatcgccatcttcatcatgcatgattttagcactacagattcgtactaagggtgtaaaaattctgctttcgtcgggggtggaaaagtcaccatacactactatgccagcaacaccagttccatgaccgttcatatctgctgttgtgtgttccgtagtatcaaaatcttcttctgcaacgactacagatttaagcaaaggatttcctgtaaaaataccagaatccagtacagtagcaagcggcgccgtttcgtcaagtgtatcatttacaatagggacataatcatattgataaagttcgtggggctcctgggtaactatctccgcaggtaattcaattgaggatataatatccatgctaagcagtgcatttaaggaaaactcattaaccttggcgcgccccagtagcaaaccagaaatcgcaaacagatcacctagcaattgactgccttgagtgcctaaaacgcttcggatttgcctctcagtcgacaatatttccgaaggattgttattataccagacatcaatattaactataaaaaaccccatgtcttttgggattgcctttataaaatctttaagatgcggtcccattctgtcctcgggagttaaacttcggacagcatctatacaggaaaacaaattacggcgttgtgcatgcgttaaaagaacttcatcgggtaaatcatcttcccaaagagcgcgttcggcattaaattgggctattgcctcttgatcctcaaattgcactatcaatttcgattgatttgatccaggttctgccgtttcttcaactagagacaacctaaatttattaattagcagttccagaaggtcacccgataaagcttctccagatagttccaacaccatcagtttatctgtttgaattccaatgttctttctggaatcaagaacattttttgatgcttgagagatttcttctgatagtttttgcccatgccgctttctatcacgaactggaggttttggggctgcagggttaggccgaccgcggtaggtagagacggtctcttgacgctcaatttgaatatgatcataatttgccatctcataaccccccttagttaatattggcttcttctcaaagaaactaatttcttttgtttttcgactgcaaattcaatgtcttttttgctatatgttcgtttcccattaaggatgcaccctcgcattattgttttacatatattttcgacatccgcataagaaaacgaattggtttcattcaaaaaggactcgaatacatgcgctggcccattaaattgttttagccgcaaaataaaaaggtttagcttttcttcgtttgacggcaaatcaaatttaatcgtatcatcaaatctgcgccatattgcataatccaaggactgttcaaagtttgttgcagcaataataattgagcgtcccctaaagcaatcaatttgctgtaaaaaagtattgaccactcgtttgatttcgccgtgctcacttgtgtcgctcctacttctgcctatcgcatcaaactcatcaaacaatatcacgaaactatcgctttttgccagatcaaaaacttttctaatattactagcggtttctcccaaatacgacgatactaatgcgtcaaatcttacatacattaatggaattccaatttcagccgcaagcacatttgcgcacaatgtctttccacagccaggagggccataaaaaagtagtttatttattggtgcaactccgttgctaattaagatatcccaattctgaaattcttttattacttccgacagttgaagcattttctcttgtggaagaataacatcatcaaaatatttatcgggatatataatctcaactagccgttcttctttgcctgatttggacaaatatgtgggtttcattgtggacatcgagtgtccaaaactcttctgtgcaccgttaagaaccatttccaagtcatctgctaaaattgcatggttcttttttcgctcatctgcaataatctcatgagcggttttcaaaaatgattctctatcattattattaaagctactaaatagctttttcaacaaatctgccctcgccatggtagcgtctcctttccaaattgcaatcagaatcgaataaagcagttagtatttactgagttccattatgatcatttcctcgataccattctttttgcaatattcgagaagtcgcatttttgccagtacactaggctcagtacgtccattttcccatcgatttattgtggagaaactcacatttagttctctagcaaactgctcttgagtatattttttttgctttcggatagattttaaaatttcagaaaagggcatgtgagtacacctccgttactgtaaattatagcatgtgctatagcagacgacaagtatcaacgtaaatatttacaacatatactccttgcttttttgaagatttttgtgtgagggtagtaataaatctacatttctatggagcatatcatattccttttcttcctgctgtattttacgaagttccgcttgcagggcggtcttgcaggaggagagttcatccagttctgctttcagcttcttggcggaaggaagtttggtgatcccggcctccttgatgtccctggccgccgcctcaaataagatgatctcactctcaaacccacgcaggaatttttccttgtcctttgacattttgtaacggtcatagataggcttcagtttgcggtaggtgtcaatctgtttgcccaggagggcaaggtcggtgagctgctgttccacatcccgcaggctttcccttgtgcggatggtggcggcggcaatggcgtcgcaccgttccttcaattcctcataactgtcgatgccgtgttcggtaagaaagttcatggtggcggccgcacgtttcagattctcaatggtcgcccaccgttggtatccggcgctctgctgggccttgatattattctgaatgtcaatgagcaggctgaccttcccgctgcgctgctggggctgtctggaggggcggatgcctccggcaatgcgggagacaacggcttcttccgtgtaatcggcacccagggttttgagccgggtaaacctctcctgagccggtgccctggcggagatatactttccccgcttgatctcgtatccttcccgctgcaaccgggcaagcaaatcgtctatgctggtggacacgggaatcagccggtcaatgacggctttcagctttgccttatagctagtgccgttctgtacggcctgatgctcaatatagctcttgcccttgtcccggccagggacgatgacggataggccgtgttctcggcacaaacggtcgctggcccggcgtatttcgtgatagctacgcttgttggaatgatagtgcttgtggtcggtgaagctgaccgcattgaaaatcagatgattgtgaatatgtcccttgtcaatatgggtggtaagtacaaactcgtacttaccatccaatattttttttgccaactgcaaccctatttcatgggcttcctctggcgatacctccccaggctcaaaggcttgaatcaggtggcggcccaggtgcgtgcctttgtcaatggcatggcggcgtgtccattcaaattcaatgtcggcggtctcggcggcgcagccaaaggaggacaccagcagcttcccgtccgtcttgtcgggattgcagatatagtcaatggccgctttcagcgttgacttaataggatgcgtctttgtaactgccatatctgatccagcctttcccggatttcttccatgtcggcctgataggtaggtcctccggcgttgacccgtttggcgatctgattgatgttccggccaatggcggacaggagtttgtttatctccttgatgtccctggtgtccacatagatgatatatccgtcgattgccatcttccgcaagtaggcaccgatccgctttgtctggagctgggccattttctgctcaatcaggctccgttcttctgccgtcaccggacagcgcaggatgatggggcgttttcgatttaccatagggtggcaccgtcctttctgcataagggtttggggctatcccaacaagcaattttgtatttagggggaaggggttccctaaagcaaaattcgcaagtgtggccacacttgctgtgcttgctctacgctccttcccccgtaaatacaatgccggaaccaccttcgtctgcccacaaaatcccggattttttcaaaagaaaagggcggcagagccgcccagaggaaacgaaaacggaggatactttcacacaccctccgtttcgtttgctgattctttagttttaagcgccccgtcaagcgcaccctcgatgatggtcaaatactgctctggacaaagtttcagtttgtggctgatacgctgtctctgtgcgctttcctcccgcatgacctctggattgaagtaccgttccacgggaagtccgcacactttgataagctgtatgataaccggcaagctaggaatcgtaccttcgttctcgatatttgcgagataccgggagtcgatgttaacgatctctgccaatgtcttgcgcgatagatgctttgcgctccgagcggcttttacatcggcaccgaaagtttcaaaaccggggcaatcttcaatattcgccatatagcatcacccacttacattgtatatttcatattttgtctgtggaatgttgctatatgctttattactacattttatttttcatactcatttcttgcacatgggcaagcgctatgatataattacaatgtttaagagcggaaagaagtggtattaatgacaaagctcaacgaagaatggctccatgcaaagccagtagattgcgacatttgcatggagtaaaaattgtcgcaaaatgaatatgctggctttgctacttgacaatcatctcaaggaggaagcctgcatgaaatacatcaatgcaaaagatcttcttcccgatgcgctagtcaaggagttgcaaagctatgtgcaagggggctatctttatgtcccgtctgatcaagcgcagcaaaaacgatggggagaagcttcgggctaccggcaggaattgcaacaacgcaaccgccaaatcgtagaggagtttcagaacggaacctctatggaggcgttagcggaaaaatacttcttgtccgtatcggccattcgtaaaatcatttatcagaaatgaaccggcgggggttgcagaaatgcaaccccgctttttgtttgatacagattgattcggtattgtctagtggatagaaaagtgtttgcatcggcagtacgataaaataacaaatacatcacaagaaaggaaaaaactatgtgtactcgatttgtctaccgaggtgatgatataatcaccggcttcaattttgagattgaccttgccgtgtggaatcacaaaatcataacagaaaaagaccgcttttatatcggcatcctgcggcccgatgggatgcgtcattcctatcatggcgtgaaccgcaacggaaatgtcggaaccttgttgtatgttcacggaaacccggagggggcctatcaggatttcaaaggttgcatgacaatcgcagacctgacagaacagtttgtgcaggcaaaaatcagttttgacgatgcactgcagatcgtgcaggaacagaagatcgtctatgccccggatgccaccatgcaggccatgttgtccgaccagcaggggcgtaccctgatcgttgaaccgggtattggctggcgggaaggcgatggacgctactcgctgattaccaattactctatccttgcacccgaaagcacaatgccctttcttgtgccgggagatgatcgatacgaaaggactgctcaacttctaaacacttacggaaagcagtttactgtcagcgatgcgttttctgtacttcaagccgtccggcaggaaggaatctgggccactagagtttcttttgtttattcggccaaggaacacgctgtttactatgtggagaacaaccatttttcactgattaagagatatgagttctcataacttcgagaggagggaaagtcatgaatccagagaacatttatcctcgcaccaacgaccacgaaaccgtttatctgaaaaatgtcatcaaaaattccaacatccttgtcggggactttaccatgtataacgacttcgtctatgatccgcggcagtttgagaagaacaatgtactgtatcactatccgatcaaccatgacaaacttatcatcggaaaattttgttccatcgcctgcggagcaaagtttttgtttactagtgccaatcatacgcaaatgtcgctatctacctttccatttcctatctttttgaggaatggggattggatgtccaaaacataacgagtgcatgggacaataaaggcgatattattatcggcaacgatgtttggattggatatgaggcagtgattttgtctggtgttaccattggggatggagcaattattggtacccgcgctgtcgttacaaaagatgttcccccttatacgattgtcggtggcgttcccgctaagacaatccgaaaacgcttttcagataatgatatagatacattattaaaaatgaaatggtgggactggccggttgaacaaatccagagtcatattactgaaattcaatcagggagaattgcggatttaagaaaactgttctcttgactttgagagttttattttgatttggctacattcagtgtatgcgccttgacttttgctattattgatagtactattgttaatagtaaaagttggaggtgtcgttatgtcgtcgattgatttagtcatacttggtattgtactggagaaaccgcaaagcgcctatgacattcagaaggatgtggagtaccaccatttttcccgctggacaaaaataagcgtaccttctatttatcgtaaggtccttcagttgagcgagaaggggtatctccaaagcgatattgtcaaaggtgataagtttgcggacaaggccatctattctattaccgatcggggcagagcgtatttcaaggagctgatggcctcttgcgccgctggcccggtgcccctattattcgatttcaatgtagtcattaccaatttgaacaagatggacaaagccgaagcagtggagctggtttcggcattgcgccagagcatacagtcctcggctgaattgaacgagggctatgcgcgggaatttgcagacattcccttggatgggagaacgatttttgaacagcagcagcttctctatcgtgctcttttggaatggctggatcactttgaagggcagttcttggaagaatgagtacaagctcccaaagcagtttgaccatcctgtttgaagctccattttggatcggtctatacgaaagaacggataacggtaagtacgaggtatgcaaaattactttcggctcagagcccaaagattacgaggtctatgagtttctgttgaagaattggcacaagctgaaattcagtcctccaatccaggccgagatagccatagagcgaaaaatcaatcccaaacgtatgcagcgcgaaattcaaagccaactgcaggataaaggcattggaacaaaggcgcagcaggcgttgaaactccagcatgagcaatgtaagctggaacggaaagccaagagccgtgagcagaaagagacggagaaagaccgccagtttgccatacggcaggaaaagaagaaagccaagcacagaggaagataacatgaagatagaatggattttatgccccttttgcggcagcaaaacgcgattgaaaatccgcgatgatacagttctggaaaactttccgctgtattgcccaaaatgcaaacatgaaaccttgatcgcggtaagacaactgaatctatccatcatccaagagccagacgctaagacgcagagccgataacactgaggaaaaacctcataggttatcggctctgtttttatatcctctatgatctgcccggcggcagaaaagaaaaaaaccgccgcggggcagacggctttctatgcgcaaaagagcacttgattcacggcggttcgattcgagccgccgtttttctttgtccagacagctcacacggcggcataaaagggggatgccgccatgctgcgccggatgctgtcaccgcctgatctgacaaaggttagccgctcaaaaaaagctcgttccagtcggcggagatgttcggccatgagtatgaactataccatgtaaataatctgcatatcacttgctattgtgcccggtgggtctgtgacctgccgggcgctttttgtcgtttcctgcggtcgggctggctggccattgcttttctcaaattttcttcaaaaaggaggcgtttagcgggcagaacacgctctcgcaggattggtagtagcggaaagggagagaaccacctgatcccccatggaaagggggtgaaactgatggaatctaacccccgcgactatggcgagcaatgccggttcgatgctttttgcaagaaggtattgcgaaacgaggccagagcctacctgcggaacatgaaacgccaaagagagcgtgaagccttctttagcgacttgtcccaggcggaactggacaagctctgtgtcatggatcgttaccccagcgacagcattgtgttctcgtcgcacggctacgatctacatatcgacaacgagcttgtagccgaggcttttgccgctttgccgcagatggagcagagcattttgattttgcactgcaccctggacctggcagacggtgagatcggcaatctcgttgggatgtcccggagcgccgttcagcggcaccggacgagggcgctgcaggagctgcgtgaaacattgtcggcgctgatgccgaaaggaggctgaggaagatgacagagcccatccacaagggaaaggacctgccgtccgtttgggtgatccacgcggcctccggcggtgacagcgaggccatggagcaagtgctgcggtactacgacgactatatgagccgcctgtgtacccgtactctctatgacaaggacggaacccctcatgtgtgcgtggatacccacatgaagcgctgtctggaaatccgactgatccgggccgtgatgcgcgcctgatcctttcagccctggcagaaggcaagcggcttaccctttcctcctttgccgatgccggggactgaccccaccttgacaaagaaagccttcgggcagcataaggcagacggatacgatctgtctgtgtggagccggtcggccggtgcgccatgaccctgttgcaagtccgcaggacgggacccctaccaaacaggtgagcgacaaaaccaggccgcgaaacaggcgtggcagtctgtgggcgaggatacacagacaggataatgagactcccgcgttgaacgccctcaaagcattgcgcggcgcacccatcagcatgggccggggtgagattcccgtggagctgcggccagcagccatccgtttttttgcctcttttattttcagataaatcttctgcttttctgtttacggataattcgtaaactttccattagcagcagacaaacccgaagcggcgcggtacaatgagggtggaagttatgaatgaacacccttttgcgtgccgtttctgactggaaaggaggctgctgtgtcagaaattcagaacggtacggagagaaggcctttggagtgccggacctatacggtcaacgagattgcccgtatattaggcgtcagccaggcacgggcatatagacttgtgcaggagggccttttcaaaagcgtacgaattggcaacgccatacgaatttccaagcggtcgttcgaccactggctggagtcacttgacctgtgacacaagaaaggaaggttcgttatggcatccattatcaaaagaaagaaaaactattccatcgtctacacttatgtggacgagaacggtgagaccaagcagaagtgggaaacccgcacttcctatcaggaggcattgaagcgtaaggcggagattgagagccagaaaagctccaactctttcctgccgcccaccaatcagaatattgcggagttcctgtccgacttcgtctccctctatggcgaaaagcggtggggcgtgtccatgtatgacagccaaaactcgctgattgccaactacatcaaccccatcatcggggatatgaaggtgcaggacatcaccacgcgggtggtggataagtacatccagactttgcagaaaacccctgcggtgaacaccaggacgcaccacgccaaaacggagtttgtcaccaacgccactattgagaagattattaagctcctccgctgtgccttcaagcaggcggttcggtgggaactggttgccaagaatccctttgacaatgtggtgctgcccaaagtggaatacaagaagcgggacatctggaccgccgatatgatccgcgccgccctggatcagtgtacggacagcaagctctatgtggctatgaacctctcttttgcctgctcgttgcgtatgggcgagattctgggactgacctggagcaatgtccacatctccgatgaagaaatcgctgatgacaatgcctatgtctacatcgacaaggagctggcgcgggcctccaagcgggccattgagatgctgggacaaaaggacatctaccatgtgttcacgcctctgtttcccaataccagcaccaggatcatcctgaagaagcccaagaccgattccagcatccgtaaggtgtggctgcccaagaccctagcttacatcctgcgggaatggaaatccgcgcaagacgagttgcggtcgctgctccgtgacgagtatcaggacttcgatctggtggtggcacttcccaatggacggccctgcgaggatcggatcatcctcaaagagtttgcaaagctacgggagaaagcagggttgcccaaagtggtctttcactccctccgccattccagcaccacctataagctgaagctgaaccacggcgacctgaaggccactcagggcgataccggacacgcccagatcgacatgatcaccagcgtgtatgcccacattctggacgaggatcgcaagatcaatgcccagaagtttgagagcgccttctatgccaatcccgacctgcgttcggttcgtcccccggaggaaccaaaggaaccggcacccgccacattggatttggagtccctggtggaacagcttcgcaagtcgccggaactggccaacacactggctgcattgctggtgtcggccccatccgaaaaatagggcgggaaaatcgtattagcaaatcggcgttttttattagcaaggccggaaaaatagttcgaagccaattagcaggcatacagcggaaaatgtataaaatcgttccggcggagcggcaagaatactccgaagaaacgataacaaaaaaccgctgtaaaccaccgaaaaacggcttacagcggtcatttttggcacccccggctgggttcgaaccagtggcctgtcgcttaggaggcgaccgctctatccaactgagctacgggggcttatacagaaaatattcaattttacagggctccaggattcgaacgattcgatttttaggaggcggtcgctctatacgactgagctacaggggcatatcaaataggcagaaaccattgtacctgttttccgccctgctgtcaatgggaaagggctgccgcgcaggcggcagcccttcggcgctcactggatgacccgtacccggatcacattctccagcgccgtcacctcgtcgatgacgcactggtccgccggggcgctcaggtccacgatggtgtaggcgtagtccccccgggacttgttgctcaggttctccacattgatgccgtcccgggacagcagggtggtgatgctggccagcatggcaggcacgtttttgtggatcaggcacagccggcacacgccgctgcgctcctggctgacggcgggcaggtttacgctgttgcggatgttgccgttttccaagtaatcccgcagctggtccaccgccatgaccgcgcagttctgctcactctccggtgtggaggctcccaggtgaggcatggccagcacgtggggcgcacccaccaggcggttattggggaagtctgtgacataggccgctacccagccggtgtccagcgccgccagcatggcatcgtcgtccacgatctcgccccgggccaggttgatgaaccggacgccccgtttcatggcgccgatggccttggcgtcgatcatgcgctctgtgtccttggtgtagtggatgtggatggtgatatagtccgcccgcttgtagagctcgttgatgtccttcaccacatggatgtggcggtccagccgcagggcggcatccacagacaggaaggggtcgtagccgtacacatccatgcccagggacaatgcgatgttggcgaccaatgacccgatggcccccaggccgatgacgcccagcgtcttcttgtacagctccgggccgatgaaggcggccttgcccttctccactacggtggtcacgtccacgccggaggccacctgctgccggacccactggatgcccccgtccacgtcccgggagcccatcagcatggcgcacagcaccagctcctttacggcgttggcgttggcaccgggggtgttgaataccacgatgcccgcctcggagcagcggtccagggggatattgttgacgccggccccggcccgggagatggccagaaggtttttcggaaaatcatagtccagcagcttggcggagcggaccaggatggcgtcctcgtccgtctccgaatcggagacggcgtacagcgccggatccaggcggttcaggccgacgggagagatcttgttgaatgttctgatacggtacatggcagaatgcctccattgggcggccccagcgggtcgcggtacttgcgggggaacgtgcggtgctggcaccgcttccgccgcagcatcttctattataggtagaggccgccgtcccagtcaatgtgccgaaccgccaaatccacggccggttgggccgaaagtttttggagaggtattacttttggaacggcctgggaaaataccccaaaaggcagttctgcgcctccggaactgccgctttcctatgaaaactgcggaatcgtcctgtttttttgaaaaagcccctgaaagcagcttgcaaaaatcgagagaacggcatataatgcaaaactgtgtgcaaatctcgaccggcggccggaatcggacggccggcagggaggccgcgtgtgttgatccgccgcccggcgtaccccacgtggccccttcatagagaaaaggagatggaagatgtgcagaacgaacatttgaggaacatcgccatcaacgcccacatcgaccacggcaagactgccccacagggctgacaccctgcggggatcgtttgatagaaatgcccggcggaagcacccgcaaggggtacgccacatccgtaaggcgggaaagccgccaacggctgtgcagtgaattccgcctccgccaaggttttgccgcaggcaaaacacttgtacgcgccgcccggcgcggccttgccagagaagaaggagaagagaattatgcagaacgaacatttgagaaatgtcgccatcatcgcccacgtcgaccacggcaaaaccacgctggtggacgagatgctgaagcagggcggcgtctaccgggagaatcaggaggtggtggaccgggtcatggactccggcgacctggagcgggagcggggcatcaccatcctggccaagaacaccgccatccggtacaaggacaccaagatcaacatcgtggataccccgggccacgccgacttcggcggcgaggtggagcgcatcctgaagatggtcaacggcgtcatcctgctggtggacgccgccgagggccccatgccccagacccgcttcgtgctctccaaggccctggagctgggccaccgggtcattgtggtggtcaacaagatcgaccggcccgaccagcggatccacgaggtggtggatgaggtgctggagctgctgatggacctggatgccaccccggaacagttggattcccccatgctgttctgctccggccgcaacggcaccgcctcctactcccccgacgtgccgggcacggacctcaagcccctgtttgagaccattctggagtatatccccgccccggaggcagatgtggaccagcccttccagatgctggtcagctccatcgactacaacgacttcgtgggccggatcgccatcggccgcatcgagcggggcaccttgaagcagaaccaggacatcgtcgtgtgcaactaccacgacccggaggctgtgctccgtaaggcgagagccaccgccatctacgagttcgagggccttgcccggaatccggtgaccgagtccaccgccggcaacatcatcgccatgagcggcattcccgacatcaccatcggcgacaccatctgcgtcccggactgcgtggaggcgttgcccttcgtgaagatcagcgcccccaccctggagatgaccttctccgtcaacgactccccctttgccggcaaggagggcaagttcgtcacctcccgccagctgcgggaccggctgtaccgggagacgttgaaggacgtgtccctgcgtgtgaccgacacggacaaggagactgccttcaacgtggcgggccggggcgagatgtccctctccatcctcattgagaccatgcgccgggaggggtatgagttccaggtttcccccgcccgcgtgctgtaccaggagatcgacggcgtcaagtgcgaacccatcgagcggctggtggtggacgtgcccggcgactgtgtgggcgcggtcatcgagaagctgggtgcccgcaaggcggatctggtggagatgactcccgtgggcgagcggatgaagatcgagttcctgattcccgcccggggcctcttcggctaccgcagcgatttcctgacggacaccaagggcgagggcatcatggccagcgtgttcgactcctacgccccctacaagggcgacatctcccgccggggcaccggctccatgatctcctttgagaccggcgagtccgtcacctacggcctgttcaacgcccaggagcggggcaccctgttcatcgggcccggcgtgccggtgtacggcggcatggtgatcggcgtcagcccccggagcgaggacatcaccgtcaacatctgcaagaagaagcagctgaccaacatgcgggccagcggctccgacgaggcgctgcggctggtgccccccaagcagatgagcctggagcagtgtctggagttcctggcggacgacgagctgctggaggtcacccccaagagcctgcggatgcgcaaggccattctggaccacgagaagcgcatgaaggcgctgcatggcaagaagtaaaccggccattgcatgggccctggcccccgggagggggccggggcctgttcgtttgccgcccgggcaggaggcgggggctgttgggaaagaccgcgccgcatccgcaggggggcgatgatcccggcggcccggaggtggactgccccgcgggggaaaccagccgctccgggatgccgggccccgcaggctcgggtacagcgccctccgcggcgcctcaaaaatatttgttaaaaattctgccttggacgggaactttttcccgctgccctgcgtcagtacaggcaaacggagcagatgctcccccgaaagcattggaaaggatgaacgagaatgaaaaaacggattctgcaatgcctgtccctgatcctctgcgccgccatgctggcgatccccgccgcggccgcggagaccgctgacgaagaagcgcccgcccgcctgggccccgcggcctattggggcactgtcacctggatggatgaggacaccttcctgctggacagcgggaaggaggacggcctgggcgacgcggtggtggtccacgtgggggatgccccctacctggacgccgtcaccggcaacaccctgaacctggagacgctggaggacggggacgccgtctatgcctgggttggccccgccatggcgctgagcctgccgccccagtccacggccagcctgatcgtgggcaacatccccgccgactacgccgtgccccagtactatgagatcaccagctccaccgttacggaggagtccgcggtgctgcatgtggcgggcagcaatgacacgatcaccgtgcccgcctctgcaaagctgacgccctacctgacgaagaacattgtcaccctggccgatctgcgtcccggcgcccgcatcctggtgtggtccgattccaagggcacgccggagaaggtgctggtgttcgcctacggctatcggggctatatcagcgtggcggaggacggcgtcgtgtccgtcaacggccagtccacgactcagaaggccaagaccaccgctgacggcgacaccctgctgcccatccgggcggtggcggaggccctgggcatgagcgtccgctgggacgcgaagcagggcgccgtggtctcctatggcgatgacatggtgaagcctgcccccctgaccacggagacgctgatgaccgccatgcccggcggcgccatcgccgcggtgaacagcgacggcaccacggaggaggtctacggcacctgcgtgaaggaggccggtgtcacctatgtctcccgctccgcgctggcccaggcgctggacctgtatctggcggactgagtccggcacaacagaaaaaccgcgtatcagatccccggaggaaatttccaccggggatctgtaacgtttcgggggcgctgtgcgttaatttggtgaagggagggaggaccgtggactttgagattctctatcgcctgtatttccgggatgtctaccgttatgtccggggactctctcgggacgaacatctggcggaggagatcgcccaggagacctttgcccgggccctgggagcggtggaccggttcgacggccggggagacgtccgggcgtggctgttcaccatcgccagaaatgtctgggtggaccattgccgccggcaccggcgggagacggagctgccgggggaggatctgcccggcggcggagactttgccggggcgctggaggaccgggaggaggtcttggccctccacagaattctccacaccctgccggagccctataaagaggtgttcggcctgcgggtgttcggggagctgcccttccgggccatcggacaggtcttcggaaagacggagggctgggcccgtgtgacctactaccgggccaaaagccggatcttgagacaatgggaggcggagcgagatgaaagtgagctgtgacgtgatccgggacctgctgcccctgtatactgaccaggcggccagtgccgacacggtcgccctggtggaggagcacctggcgtcctgtcccgcctgccgggaggagctggggcgcttggggacagccctgccggcggagccggagggggtggagcccctgcggcgcttcaagcggcggtggcggcggaggcaggtcctcatcgccgtgacggcggcagtggtgacggcggcggtggcgggggggatcttcctgacctgcttctggggccgccgcgtggcggcgggggatgtggaggtctctctggaactgcaatggtcaggcctcacttccggggaggattccggaggagacgggagccggggagagctggaacaggggaactggagcggcgtgatacatgtctgctcatcgcatgagaagaacctgcggtccagaatagagcctttttcagagacagacgaaaatggagtcatcgttcgggcgggctatgtcatagacatgtgggaggtgccggaccgggctcccagtggctcgggctcgatcaccgccggctatggctatcccaatgaggcggggccgatcccagaggactttgatatcgtctttattgtccgctaccgggatggagaagtcacttactccgtccgggagatgggactactggacccggcggggtgagaaaaacttgcgggagcagaatggcggcggggcttgtccacgccgctgtttcccgttataatggaggcaacgatttttcgatcagggggaattggaccatgaacacccgcatcgaacacgacaccatgggcgagattgctgtcccggcggagcatcactggggcgcccagacccagcggagcctggaaaacttcaagatcggcggccagcgccagccgcaggagatcatcaccgcctttgcctatttgaaggaggcctgtgcccaggccaacgcggactgcggcaagctgacggcggagcaggccggggccatcgccgccgtgtgcgccgagatccgggcggggaggtggaatgacgagttccccctggtggtgtggcagaccggcagcggcacccagaccaacatgaacgtcaacgaggtcattgcccacctagctgcggaccgggggatgcggcttcaccccaatgaccacgtgaatgcctcccagtccagcaacgacacgttcccctccgctctccacatcgcggcggccctgagcgtcacggagcaggtgctgccagcggcggagcggctggcaggggccttccggaggctggaggaggcctatccggacctgatccgcattggccggacccacctgcaggacgccacgcccctgaaattcgcccaggaggtctccggctggcgggagctggtggaggccccctgccggatgctgcgcaccgccctgccggagctgaccaaactggccatcggcggcaccgccgtgggcaccggcctcaacgcccccaaggggtacgacgagatggtgtgcgggcggcttcgggccatgaccggggtggacttcaccccggatgccaacaaattccacgcactgaccagcaaggatgccctggtgttcgcccacggggcgctgaaggccctggccgccaacctcatgaagatcgccaacgacatccggttcgaggccagcggtccccggtgcggcatgggagagctgaacatcccggagaatgagcccggcagctccatcatgcccggcaaggtgaacccaacccagtgcgaggccgtcaccatggcggccgtgcaggtgatggggaacgacgcggccatcggctttgccgccagccagggaaacttccagctgaatgtgtttctgccggtgagcgcctataactttctgctctccgcccggctgctgggggatgtgtgcgattccttccgggtccactgcgtggagggcatcacccctaatgtggagcggatgacggccaacctgcacaactccctgatgctggtgacctgcctgacgccgaggatcggctacgaggcagcggcggcgtgcgccaagaaggcccttcacgacggcactaccctgaaagaggcggtgctggccctggggtatctgacggggccggaattcgacgagacggtacggccggagaaaatggtataagagaagagtatcccgccggggacgaaaagattcgctcccggtgggatactctgcgtttccgggacgtttaccggacgggggggatgcgcccccaagagagaagaggaggcgagcgcgttgctttccatgctgctggctatgctggagacggaggaggaccgggaaaggtttttgaagctccatgggacctatgagaagaagctatacgccgtggcggtccgtgttctgggggaccggaccgcggcggaggacgcggtgcagcagacttggctgcagctcatccggcggtgggaccgggtgagcggcctggcctggagcgagacggagggatatctagtgaccgctgtgaagaacgcggcggtggacatgctgcggaaggagcggtgggaggaagctctgccggaggactgggatccgcccgctccggagacgggggagacggactaccgctatctggtgagcctgatccgggcgctgccggagagctaccggcgggtgctggagctgaagtgcgtggaggaggagagcaaccgggagatcgcccggcggctggggctgaaggagtccaccgtggccacccgcgtcctgcgggggcggaccatgctggcggcggcgctggagaaggaggggtacgtccatggatgagcggatgctgcgccatgccctgatggaggccaacctggagcggttccgggacgtgctggacgcggcggaggaaccggactggtcccaccggtatttgagaaaccggacgcggctgctggcggatcccttcggctgggcgaagcggatggcccggccggtgtggaagcgggcggcccggacagcggcctgcgtgctattggcatgcctggtgaccctggggggcctgatggcggtgagccccgccgtccgggcggcggtgttggggtggttccatcaggtgcaggaggatctggtgacctttatcaacccgaagcggaccgtggcagaggatccgcccggcggctggcggctgtcggagatcccggagggctttgtgctgacggacgtgagtcccaaggagagctcgggctattggaggtactatgagccggggaccggcgcatggctgtggtttgccgtctacacgccggaggcgggagaggtagctaccaatgtggacggagcctcggacgcgggggaaaaccacaccaccgtcactgtgcaggggtaccaggcagacctcttccagtcggaggggacaatcctgctgacctggcagaacgaggcgggatacctctttatgctgcgggccacggattttggcgacaccgagaccctgctgtccatggcggaaggcgtggtgccttacgagggacccggtgtggcctgggagatgggctgggtgccggagggctatgaacccatgtaccgggatgaaggcgctggagccgtccagcaggtgtgggtcagggacgggacaacactgacctggcagtatgtcactgaccccatctgccccttcgagaccccggagggggagccggaggagatcgacctgcggggcgtcaccggctggtactggacggcggaggaggagccggaggagagcgatggccccaccattactgtgaatggggaggagattcaggcggagggctcctccgtcaccgtaggcggcgtcaccatcatcaccggcggctccccggacacagaggagaccggcactctgatctggacggacccggacaccaacacgaccttcttcctggagggggccctggaccgctttgacctgcgggacatggctgtccgtacggaggagacggagccgcagctctcacctcccacgaagagagcgcagtcgatcaccggcactgccggcggtgggaagtgaaacagtcagactccacagaaagagacgagatctttgtgatttttgacaaagatagaaaagtccgtggatacgtcctgcccacggcacgttcaactaatagaacggccgggggcctgtcccccggaaacacacggagacagaaaggaaggagttccatgaaaagacgagtcctatcattcctggccggcgcggccgcggcgttggcgctgacggccctgaccgccaccgctctggcggcctccgggcaggtgcagttcaacttcgctggggtggctctgaacggcgagacaaagatcgccgccggcagcgacatcaccgcccccaacggccagcgggtccccggctccatcctctatgtggatgaggctggcggcaagaccaactacctgcccatccggaccatcagcgagctgctgggggtgaaggtgggctacgactccgccacccgcacggtgctgctgggggagcagaccgagccggcctccgcagccgtcgcttcagggctctactggcacagggagaccgatgaggacggcgtcacatacgccagcgaggaccctgggatcgactacaccgaagcccctggctacgcgctgacaaagctgccggagggctgggagctggagtccgtgcgggccggaatgggcggcagagggaatctgagctactggaatggcggcgggcgcatctccttctcctgtgcctatcccgacggcgggagctatggctggagccccggcagcggggagatcccctgccgcaccgtcaccgtgaacggccatgacgcggcgctctacacctacagcagcgaatacggcgacagctgcctgctggtgtgggaggacgaagcgggggtgctgttctggttcaccgggtcggacgtggacccggacacgctggtggaggccgcctcctccgtggagcccacatcaaagactgcgcccgcttgtgaggctgactggctgcccggcggctacagctggtttgaaaccaacgcctccggcggcgcggcggagactacctgggtcggccagggcggcaatatcaccctgacctgctctgccacccccttgctgatgccggagggagatggagagaccgtgcgcttcggcggtgtgaccgccaggttctgggaggcggagaagcctcacgaggcggagacggatgcgtgggagcctgagacggtgggcggcgtgattatctcgtctggcaccatctccggcccccaggcagcggatgtggccaccctggcctggacggacggcggcctgaacttccgcctccacggcactgtggatcaggagaatctgctccatgtggcggagagcctgcggatcaagtgaagatcggacggcactcataaaagcagccccggcgtgcaaagcacgccggggcttttctgtcagcagctctggccgcagctacaggtgaagcgggtcgtgacataccgccgcaaaaagcagaggatgccgcctgccatcagggccaggaaggcgcagcaaagcgccgcgccgatgtggagccccacgccggaggcggtggagagggcggtaatcagcgccgtcagcagcgcccccagggcgcccacagcggaggcctccccgcagcagagccaggcgtccgccagggccggcgtgcggtctgccagcaggccgcccagcagataggccagcaggccgccaagaccggcggcagcggtggccgcgaaaaagaacagagccgtgggcgtggcggccgtcagggtcagcacgtccgtgcgcagcagggcgaacaccaggccgcccacagccagggaccccagcaccagggtcagaagataacagaagcagcgtttcataggaccagcctttctatcaaaacgcgcaggtccgcccggcggggcgaccgccccgcagtccagcctatgcgctgggtgcggagattgtgtgagcgagtgtatatattcatatttttttgaatatcgaaataaatatacggttttctaagacgttcatcgaaattttatgcaaaaatgcgcggaagaagctggaaatgttgtgcaaaatgatgcttgaataaatatgcgtgaaagatgtataatccaaacatcatcaatcaaaactccacggagggaattcattatggatcagaaaaacatcaagaagatcgtgctggcctattccggcggactggatacatccatcatcatcccctggctgaaggaacactacaacaaccccgagatcatcgccgtatccggtgacgtaggccagaacgacgagctggaggggctggaggagaaggccatcaagaccggcgccagcaagctgtacatcgcggacctcaccgacgagatggtggacgaggtcatcatcccctccctgaagatgggcgccagctatgagcagtatctgctgggcacggcctttgcaagacccatcattgccaagaagctggtggagatcgccaaggcggagggcgccgacgccatcgcccacggctgcaccggcaagggcaacgaccaggtgcggtttgagctggccatcaagcggttcgccccggatatgcccatcatcgccccctggcgggagtgggacatcaagggccgtgacgaggagatcgactacgccgaggcccacaacgtacccctgaagatcagccgggagaccaactactccaaggacaagaacctatggcacctgagccacgagggcctggacctggaggacccggccaacgagccccagtatgagaagcccggcttcctggagatgagcgtcagccccatcgctgcccccgacaagcccacctacgtgaccatcgactttgaaaagggcgtgcccgtggcggtggacggggagaagatgaaggccagcgacgtgatccgcaagctgaacaagctgggcggcgagaacggcatcggcctgctggacatcgtggagaaccggctggtgggcatgaaggaccggggcgtgtacgagacccccggcggcaccatcctctacaaggcccaccagtgcctggagatgattaccatcgacaaggataccgcccacatgaagagcaagctggcggtggacttcgcggacctggtgtacaacggcaagtggttcacccccctgcgggaggccctcagcgccttcgctgacaagacccaggagcacgtcaccggcagcgtgaagctgaagctgtataagggcaacatgataacggcctctatcacctcgcccgagtctctgtactccgaggaactggtgaccttcaacgagagcagctatgaccagaccaacgccaccggcttcatcaacctgtggggcctgcccgacacagtgctggcactgcgggagcaggggaagctctgagagatttcggaggggagcgggctcccctccgagccgccccaccaccagtcctcagactggtgaacgctgcccagggcggctggggcaaagtattttcggcaggtacacgccctgccgaaaatgttttcaatatgcccggcggggagaggcaagaccattacaagaccacaggggcggggcggagaggcttcttcgccctgcgtctgccatgaaaggaacaacagcttatgaaactctggggcggacgctttcaaaaagacaccgacctgctggtgaatgaactcaacgcctccatcagctttgaccagcggctgtacagggaggacattaccggctccatggcccacgccgccatgctggcggactgcggcatcatctccaaagaggacgccgccgccatcaccagcggtctggaggacattctggcagacatcgaggcggggaaggcggcattcaccgccgacaacgaggacatccacatgaacgtggaggccctgctcaccgcccggatcggcgacgcggggaagcggctccacactgcccgcagccgcaatgaccaggtggccctggacttccggatgtatgtccgggagcagatccccgtcatcgtggggcagctgctggagctggagacggtcctctgccgtcaggcgaagaagcaccagaccgccgtgatgcccggctacacccatctccagcgggcgcagcccatctcctttgcccagcatctgatggcctatgccgccatgttccgccgggacgtgacccggctggaggactgcggggcccggctggacgagtgtcccctgggatccggcgccctggcgggcacaacctatcccatcgaccggtgggagacggcaaaggccctgggcttcgccgcacccatgggcaactccctggacggcgtcagcgaccgggactacgcgctggagcttttgagcggcctgtccattttgatgatgcacctgagccgcttcgccgaggaggtcatcctctggtgcagctgggagttcaagttcatcgagctggacgacgcctatgccactggctcctccatcatgccccagaagaagaacccggacgtggcggagctggtccggggcaagacgggccgggtctacggcgacctgatgagcctgctgaccgtcatgaagggcctgcctctggcatacaacaaggacatgcaggaggacaaggagccggtgttcgacgccgtggacacggtggagatgtgcctgccggtgttcgccgccatgctggacaccatgaccgtccggacggacaatatgcggaaggccgccggccacggcttcatcaacgccaccgactgcgccgactacctgacgaaaaaggggatgcccttccgggacgcctacaccgtcaccggccatctggtggcccagtgcacggcccggggcaagacattggaggaactgacgctggaggagctgaaggctgtctccgagctcttcgaggcggacgtgtatgacgcgctgaacctggagaactgtatggccctgcggagcagctacggcggcccggcggtggcggagaccgcaaggcagatcggggagatcgaacagttcattcagaagatcaaagagaacagataaaaggataaaagataggcagatccggtaatatctcttatcccttatcttcactggggtgatgatatgaaaccaaaggtctacatcgacggaaaggacggcaccaccggcctgcaaatctatgaccggctggcggcgcgggatgacatcggcctgctgctgatcgacgaggcgaagcggaaggacccgggcgaacggaaacggctgatggcggaagcggacatcgtgtttttgtgcctgccggacgcggcggctgtggaggccgtggccctggcggagggctccggcgcccggatgatcgacgcatccaccgcccaccggacggcgccgggctgggtctacggcttcccggagctgcggcccggccagcgggaggccatcgcgggggcccgatatgtggccaaccccggctgccacgccacggggttcatctccattgtcgcgccgctggttcaggcggggctactgtccgcggacgcggacctgtgctgcttctccctcaccggctactccggcggcgggaagaaaatgatcgcccagtacgaggcggcggagaaggcagagagcctttacagccccggcctctacggcctgacccaggcccacaagcacctgccggagatgcagaagctctgcggcctgaaaaagcccccggtgttcacgcccatcgtggatgactactacaagggcatggctgccacagtgcccctgcacaggagtcagctgacgggggaggccaccctccatcaggtgtggcaggcgctggcggaccactacgccggggaaaagctggtccatgtggccccggaggggagcgcggacgcaggatccaagctgtacggcaacgccagagccggggacaacggcctgaccctggtggcggcgggaaatgacgagcgattcaccatcaccgccctgttcgataacctggggaaaggggcctccggcgcggcggtgcagaacatgaacattatgctgggatttgaggagaccgctggactgctgtgaggcaaaagtgaagaaaagagataagggataggcgcgccctgattttggcgggggagagatgtcccttatctgttgaagagaggatgatacgatgctgaacttcatcaccggcggcgtgtgcgccgcccagggcttccgggccgggggcatccacgtgggggtcaagacccacgcggcctggaaaaaggacgtggcgctgatcgtgtccgacgaggactgcgcctgcgccgccgtgtatacgaaaaacgccgtgaaggccgcccacatccatgtggacaagcgccatctggcggacggaaaggcccgggctgccgttatcaacagcggcaacgccaacgcctgcgcccccatgggagaggaaaacgcggagcgggtctgcgcggcggcaggcaaggccctgggctgccggccggaggatgtggtggtagccgccaccggcgtcatcggtcagacgctgaacgtggcggtcatcgagcaggggatgccggagctgtgcgcggcggcggcccacacggcggcgggcagcgacgcggccgcccacgccatcatgaccacggacaccgtcaagaaggagctggcagtggagaccgttatcggcggcaagaccgtccggatgggcggcatcgccaagggttccggcatgatccaccccaacatgggcaccatgctgtgcttcctgaccaccgactgcgccatctcctcggagatgatcaagtccgccctgctggagaccgttcaggccagcttcaaccgcatcagcgtggacggagacacctccaccaacgacacgtgctgcgtcctggccaacggcttggcggggaaccctgtcatcacggagaaggggccggattacgacgcctttgtggaggccctgcgcgccctgtgtgtggagctggcgaaaaagatggcctccgacggggagggcgctacccacctcatcacctgcaccgtcaccggagccgggagcgagcagagtgctgagaccgtcgccaaatccgtgatcggctccgccctcaccaaggcggccatcttcggtgcggacgccaactggggccgggtgctgtgcgccatgggctattccggggaggacttcaatccggacaaggtggatgtggccttccagagtcaggcgggcagcgtccaggtgtgcgctaagggccgggggctggattttgatgaagatctggccaagagggtcctgacggagcacgatgtcaccattgccatcaccatgggcgagggagatagcagctgcacctgctgggggtgcgacctcacctatgagtatgtgaagatcaacggggattaccggacgtaaaccgggatgcccgatagtgcccttgcggggagcggagatgggccgctgtccggcggcctatccgcaccccgtagcgggtgcatctgtccagtcatcatagctgccattcccgcgtcccatgggacacctcctccccctccggcggaatcccgccgattttcaagaaaagagttgatgttacgatgtcctcccacgcacagcaagcgcggacgcttgtggaagccctgccctatatccagaaattcaccggcaagaccatcgtggtcaagtacggcggcaacgccatggtgtccgacgaactccgccgggctgtcatgtgcgacatcatcctgctgtccctggttggcattcgggtggtggtggtccacggcggcgggccggagatcagcgagatgctgaagaagctcggccacgaaagccggtttgtggacggcctgcgctataccgacgccgagaccatggacgtggtccagtccgtcctctgcggcaaggtcaacaagaatctggtggcccagctgaaccgtctggggggccaggccatcggcctgtgcggcatggatgggcagctgttccaggcggagcagctggacgagaagtacggcctggtgggaaagatcacgggtgtgaatccggagccggtggaaaacgccctgctcagcggctatatccccgtggtgtccaccgtggcccagggcgtggacgcggacaccgcctacaacatcaacgcggataccgccgcctccaagctggcagccgccatgggggcggagaagctgatcctgctgacggacgtgcggggcctgctgcgcaatcccagggacgaggagacgctgatccacgtggtccacacctacgatgtgccgggcctggtggcccagggcatcatctccgggggcatgatccccaagatggagtgctgtgtggacgccatcgccggcggcgtggagcgggtccacatcctggacggacgcattccccattccattctcattgagctcctcagtgatgagggcatcggcaccatgttgaaaaaggaggactgatcccatgaccagccaagagatcaaggccctgaccgggcagtacatcatgaacacttacggccgcttcccggtggccatcgaccatggacagggcgccacgctctacgaccccgagggcaacgcctacatcgacttcaccagcggcatcggcgtcagcgatctgggctatggttgtcagccctgggtggacgccatcgccaagcaggcggggaagatcggccacacctccaacctgttctacactgagccaccggcccggctggcggagatcctctgcaagcggaccggcatgagcagcgtattcttcgccaacggcggcggcgaggccaacgagggcatgattaagctggcgagaaagtacagcttcgacaagtacggcaggggccgtgccgccatcgtcactctgaacaactccttccacggccgcaccatcaccaccctgacggccaccggccaggacgtgttccacaactatttcttccccttcaccgaggggttccggtatgccgacgccaacgaccttgcctccctggaggccgcagcgggggacgacgtgtgtgccgtcatgatggagctggtccagggcgagggcggcgtgctgcccctggaccgtgactatgtgaaggccgttgccagactgtgcgcggagaaggactggctgctgctggtggacgaggtccagaccggcgtagggcggacgggcagcctcttcgccttccagcagtacggcattttgccggacgtggcgtccttcgccaagggcattgccgggggactgcccatgagcggcattctggccaatgagaaatgccgggacgtgctgggccccggcactcacgccaccaccttcggcgccaatccggtgtgcgctgccgccggtctggtggtgcaggagacgctgacggacgcgtttctggaggacgtccgggccaagggcacgtatctgcgtaaccagatcgaggcgctggacctgccctgcttcggcgccacccggggcatggggctgatgatcggcatccaggtgaaggacggctggaccaataaggagatcgcaagcaagctgatcgaaaacggcctgctggtgctgaccgccggaccgagtatgcggctgctgccgcctcttgtgatctcccaagaggagatggaccaggggctggagatcctgaaaaagacgctctcctgaatctgtctttttcgctccggccggggacctgctgcgccccgccgtgactccggcacttacacgaacacccgctataactctaacactaacactaactataaccctaactataaccctaactataaccggagaattttacacaattttcccggactaaatgataaaagcgcccatggcgggacagagaggagacacccatggaaaaccacacccattttttaaagctcctggactttaccccggcggagatccagcagttcctggacaccgcagcagatctgaaggccaaaaagaaggccggcattccccaccggtatctggaggggaagaacgtggctctgatcttcgaaaaaacctccacccggacccggtgtgcctttgaggtggcctgccaggacttaggcatgggttccacctacctgggtcccactggcagccaaatcggtgtgaaggagtccatcgccgacaccgcccgggtgctgggccggatgtacgacggcatcgagtaccggggcttcggacaggaaattgtggaggagctggcaaactacgctgaggtgccggtgttcaacggcctcaccaatgagttccaccccacccagatcctggcagacttcctgaccatccaggagcacttcgggagactcaagggcatcaagctggtgtatctgggggacgcccggttcaatatgggcaatagtctgatggtgggctgcgccaagatggggatgcactttgtggcctgcgccccaaaggcgtacatgccggaccagaagctgatcgatacctgcttacgtctcgccgccgagaccggcgcggtgctggagttcattgaagaccccatggaagctgtcaagaacgccgacgtgctgtacacggacgtttgggtctccatgggggagccgatggaggtctggcaggagcgcattgccgccctggcgccctatcaggtgacaaaggccctgatggacaacgccgggccccagtgcaggttcatgcactgcctgcccgcctaccatgaccacaagaccaaggtggggaaagagatgggcgagaagttcggacgggagaccatggaggtcaccgacgaggtgttcgagtccccggcctccatcgtctttgacgaggcggagaaccggatgcacaccatcaaggccgtcatgtatgagctgatgaagtgagagaacgaaacagtgccccggagtatcaaaactccggggcgctgttatgcgtcgtcaaagcagatcccccggctgccagtcggcgggcagatcctgcggggtttggacgttcccgctctggtcgagcctgtaagcgcacagaatggtccatgtggtctggccgtggtcatcggtgatgcagacggcggctgtcagggtttccccgggcaggagttcacaggtgaaggtgtaatccgtccagttatacatttccacaaacccggcctctgcccacagctccaaggcctccggaacggggacggacgattccgggactgtctcctgatttcggtagaagcagatctccacctgagacggggaggggctgaaatgggtgttgcctccatgagagatggaaagggacaacccgcccagcgtgagtttcttgctggtctgcggccaggaatcgctctggaaatctctccactggttggcccagtcggtttggctgaacccaccccacacatccagccggaaatttccgggcagacagtcgtacaaggtttccatctggtcggcggcagtgacgccatccgtggtgagggatgcggagagaaggatttcctgatccatgggaagggtccaattctgagcggtgaaggttccgtttttcccagaggcctccgcagaaaactgccggccgtccgagagaagggcggtgaagagggcggtggtgttgtcctgccagcttttggcctgggccgacacctgaagggtcacagtccccgctgccaggtcgtagtccgtaacccgcgcctgggaaaccgcaaaaagattggaatcctcatccaggagatcccggatctgcccggcaagtgccccaatctggccgctgacgctgctctcgataccgtacacctgagactggacttgatccaggcggctgccaagggcggaaaggccgctgcccaaagccagcgccgccgtcaaagccgcgccgcaaatcccggcgcttacggcgatttttttcttccggctccacctggggttctggacgacctgggccgcgtcaagatatttttttgcgatggcctccactgccgccagctcccggtcggtcagctcccccgccggggcggtgccctccacgccttcaccgggggcttccggggcatctttttcggaacggtcctccgccgcttccggctctactcccagcagggcgccgatggtgacgccaaagatccggctcatggcgatcaggttctccagttccggcacggcggcgtccgcctcccacttgctcaccgcctggcggctgacgcccagccgctcccccagggattcctgagagaggccggcggcctttcgggcctcctggatgcggcggcccagggtctgctgctcccgcatggtatcaactcctttgccctcaccataccagagagcgggaaaaagcgcaaccaccggcgggtttcccggatgtcaaccacgggttgcggatgggaaaaagaaaataatttcccctgaatctcctgaaaaaacaaataaaaaatctctgcttgacaacaattttttattgttctatggtaagggcagagctgccggcggctcctgacagaactggaaggagcgaatacacatgaatcatttgaccttgcggggcacccaccgggagatgggctttcagtggggcgcccggctggcggagcgcggcctgcgcctgctggaccatgtgccctttcccctggaggcggagcggcgggcctttgcggctgcctgccacccggcgtatgcgcgccatttccccgccgccctggaggagctggaggggctggcggcggggcagaactgccggcaggaggacttggagacggtcctcttcaccacctacgccctgccgcccgcctgcggctgttcctgcctggcggtgtccaacgggaacggggtgttcttcggacggaacagcgactttctgacggcgctggagccggactacacccatgtgacatacggattttccgacagggcgatcccctttacagggaacaccacctcgtttgtgcagatggaggacgccgtcaacgcccggggactggccatcgggctcacctctgtctacacgcccaggccccggccgggtctgaacgccggcatggttctgcggctgctggcagagacctgcgccgccgtgccggaggccctggaccgcctgcgggcgctgcccctggcctcctgccagacgctgacgctggcggatgccgccggggacattgctgtggcggagtgcagcccggaggggatgcgggtggagcgtcccggcccggcgggacccttcgtctgcgccgcgaatctctttcactcggatctggcggtcccgctgccgccggggctggactcctggcgggcggcggagcggtacgacacgatgcgccgggtgctggagcgggagggggagacgctggctctttccggcgtccaggccctgctggcggggcgaaagggctttctctgccagtatgaccgggctgcggggcgggacaccgtctggtccgcggcctgcgacctgacccggcggcgctgcctgctggcggagggcaacccggggcggacggccttccgggagattcccttcccagtggagcggggggacagccgcccttgacacccgccgcccggctgcatacaatagaacggaatctgacaaaaaggaggggctgatatggagcgttccgctggcatcctgctgccggtgttctccctgccggggccttacggcatcggctccctgggccgggaggcccgggcctttgccgaatttctccacaacgccgggcagaggtggtggcaggtgctgccggtggggcccaccggagcggggaactccccctacaccagcgagtccaccttcgccgggaacccgctgctcatcgacctggaggacctgcgggaccggggcctgctgacggaggcggagttgtccgccgcccgggtgccggagggagcgcccatcgactacgccgccctctatgagagccgggaggcactgctgcggcgggccttctcccggctgggcggagcggaggcccagtccgtgcgggactttgccgcagccaatccctggctgggggagtacgccctgtaccgggcgctcaaggcccgcttcggccagacggcctggttcgactggccggacaaggacctcctgaaccgcgacccggcggcgctggcggccgcccggcaggagctggcggaggatatcgcttttcaccaggcggtgcagttctggttcttctcccagtggaaggccctgaaggaccacgccaacggcctgggggtgcggatcatcggggatctgcccatctacgtgtccctggacagcgccgacgtgtggagcgagcggagggagttcctgctggacgagacggggcggcccagccgggtggcgggcgtgccgccggactacttctcggaggagggccagctgtggggcaatcccctgtacgactgggcggcccagaagcgggacggcttcggctggtggatcagaagggtggagggcgcctcccgcctgttcgacgccatccgcatcgaccacttccgggcctttgagcggtactggtccgtccccgccggggcggagaccgccagagagggccgctgggaacccggccccggcatggacctgctgcgggtcctgaccggctggttcccccacatcacctacattgccgaggacctggggcttctcacgccggaggtccaccagctccgggaggcggcgggcctgccgggcatgaaggtgctggaattcgccttttcagaccccggcaacgactatctaccccacaactacggcagccgccggtgcgtctgctacaccggcacccacgacaacgacaccgccctgggctggtacgaccacgcgggggaagcggagcgggcctttgcggagcggtatctgggcgcctccggccgggagaatgtccggcgggcgctgctgcggtgcggcatgggcagcacggcggagctgttcgtggcccagatgcaggactacctggccctgggcagcgaggggcggatcaacgtccccggcgtggcggagggcaactggcgctggcggatggcccccggcgcggccgcggccgggctggcggtggacatccggcggctgacggaggtctacggccgctgctgaggaccggagaagcgcctgagaaattttgacggagggaaagcgcgatgaagattcgggaagtagaggagagaacgccccggctggtggaacagctggtggacgtgtgggaggcgtccgtgcgggccacgcatctgttcctctccgcgaacgagatcgcggagatcaagcggtatgtcccccaggctttgatgggagtggcgcatctggtggtagcggaacgggacgacggcgcgcccgccgcctttatgggagtccaggacggaaagctggaaatgctgttcctggcgccggaagagcgggggaaggggctgggaaggcagctcctggagcatggaatccagcggtatgcggtcgaatccctggcggtcaacgagcagaacccccaggcccgggacttttatgagcacatggggttccaggtctttgagcggtcggagctggacgaacagggaaatccctatccgattctctacatgcggcgggagacagccgccccttgacgggcggagcgttccatggtatcatttccctgtccctgggaagaagctctgaccggcggaccggacaattttggattctgtcgctctgaccggcacgggccagccccggccgcaagacggggaagcgcccggcggtgccgggcggacggcgcatgtcaaaatccccctctgccagcgcggcggaggggtttactttttggaaaaaggaggaatcctctgtggagacccgtgtggccgtgctggcgatcatcgtccgggacacggcctctgtcccggcgctgaacgagctgctgcaccagtacgccccctatatcatcgggcggatgggggtgccctaccacgcccggggcgtgaacatcatcagcgtggcggtggacgcaccggcggacgccatctccgccctgtccggcaagatcggccggctggcggggatcacggccaagaccgtttacgcgccggaggatgcgctgcaacaaggaaagtgaggaaacagaagatgaaacagtggatgaagaagagtctggcggcctgcctggccctggttatgtgcctgaccctggccgcctgtggcgggaaggagggcgagacgcccgcggaggagtccgtcaacgtccgggtggcggccctgaagggacccaccgccatgggcatggtgaagctgatgagcgattatgctcctgtggaggaagcgttggaggataaggagaatgtggtgaccgctggcggcggaaacacctatgagttcaccctggccgcctccgccgacgaggtgtcccccaagctgatgcagggggagctggacatcgcctgcgtgccggccaacctggcctccgtgctgtataaccggacggacggcggcatcgtcaccctggcggtgaataccctgggcgtgctgtatattgtggagaatggcaattccgtccagtccatgggggatctggcgggccggactatcgtggcctccggcaagggctccacgccggagtacgccctgcggtatctgctgacggagaacggcatcgacccggacaccggcgtcaccatcgactggaagagcgagcacagcgaatgcgtggcatccctggcatccggcgcggctaccatcgccatgctgccccagcctttcgtcaccgtggcccagacccagctgccggacctgcgggtggccctggacctgacagaggagtgggacgccctggacaacggctccgccctgctcaccggcgtggtggtggcccgggcagacttcgtgaaagagcacccggcggcggtcagcaacttcctggagcagtacagcgccagcgtggactgggtgaacgccaacaccgccgaggcggcggagctcatcggcggctatgacatcgtggacgctactgtggcggagaaggccctgccttactgcaatatcgtgtgcgtcaccggcacggagatgatggatatgctgtccggctatctgagcgtgctgtgggagcaggacgcagaatccgtgggcggcggtatgcccaacgacgacttctattacggcgcgtaacggctgacaaattttccgcgccccgggaacacccggggcgcggtggtttccaggagaaaggggaggcagatgaagcggcgaacaggctctgtccggctgtgggcggcggccttctggctgctggtgtgggagggggccagtctggccctggcggctaccaccggcgggcggatgctgctgctggcctctccggtgcaggcgctggggcggctgctggccctggcgggcacggcggccttctggcaggcggtggccttctcctccctccgcatcctggggggctttctcctggcctgcgcgctggcggcggtgctggcaccgctggcggcccgtttccagtgggtccgggacctgttgagccccctggtggcggtggtgaaagcggtgccggtggtgtccttcatcatcctggcgctgatcttcttctcgtcggagaacctgtctttgctgatctccgccctgatggtgttcccgccggtgtatctgaacgtgctggagggcatcgggcacacggaccggcagctgctggagatggcccgggtgttccgggtgccggtctcccggcagctgcggggcatctacctgccggcggtgctgccctatttccgctccgccgtgtcattggggctgggcctgtgctggaagtccggcgcggcggcggaggtcatcggcctgcctgccgggtctatcggcgaggcgctgtacaccgccaaggtgtacttccagaccggagacctcttcgcctggacggcggtgatcgtgacggtatcggtgatattcgagcggctgttcctccgcctggtggacgccgcagtgagaaaggcgggcagctgatggagattgcggtgaagcacctgtgcaaatccttcggggccggacggtgctgcgggacttgacctttactgcgggacccggcattacggccgtcatggcgccctccgggaccggcaagaccaccctgctgcgcatcctgctggggctggagcggccggacagcggcacggtggaggggcttgcgggaaagcggctcaccgccgtgttccaggaggaccggctgctggagcacctctccgctgagggcaatctccggtttgtgctgggccgggtttatgaccccgccgcggcccgggccctgctggaccggctgggcctgccggacacgggcgcgcagccggtgcgggagttctccggcggcatgaagcggcggctggccctggcacgggcgctgctggcgccctttgacgcgctggcgctggacgagcccttcaccggcctggaccgggagaaccgggacctggccctggcctgcatccgggagacggcgggggatcggccggtactgctggtgacccacgatgccgccgacgcggcgggatcgccggtcgtcacgctgtaaggaagaacagagcgcggcgccgcctccgggcggcgccgcggtgcgccataggactagctttttgggagagactatggtacaatggccgcaaagcggcgggagggcgcctgccatggctgggaccacgcccggcctcctgcgggacagccgcccggagcaccagatccccgcggggggtggcgcagcagccgcagcgtcagcgcaccgctcccgtgggggggccgaccatccaacaacctcaaccccggacggccgtccggggatgcgaccaaaaggagctgtctgtatgattaagatcaccaccgactccacctgcgacctgccgcgggagctgctggagcgatacaatatcaccgtgaccccgctggggatcatcaaggcggggaagctgtaccaggacggggtggacatccgcaccggggacatcgccgcccatgtggacgccggcggcgagatcaccaccaccaacgccgtcaatgtggcggactatgaggagctgttccgccgtctgatggaggagtatgacgcggtcatccacctgaacatcggcatgggcttttccagctgccaccagaacgcccgcctggcggcggaggaggtggacggcgtgtatgtggtggactccgccaacctgacggtgggccatgggatgctggtgctggccgccgcagaggccgcggaggccgggaagtctgtgacggagatcctggcgatgctggaggagatgattccccgggtggagaccagctttgtgctggaccggctggattacatgaaaaagggcggtcgctgctccaccgccacggccctgggtgccagcctgctgaagctccacccctgcctggacgtagtggacggcaagctgccggtgacgaagaagtaccggggctccatcgagaaggtggtggaggagtacgtccgggaccggctgcgggaccgcgcggacctggacacccaccgggcctttctggtggacacctgcccggacgaccacctggcctccatcgcccgggaggtcctgcgtcaggacgggcggttccaggagatcatcgaggccaaggcggggtgcaccatcttctgtcactgcggccccggcaccctgggcgtgatcttcctgcggaaggcgtgagaccgtgcgcgctgcgggcggcaggcccggcggcccgcttcccgcgccctggcatcaaacagaagagccggcccctctggggaccggctctctttgctggaaatcagatttacttgacggcgatggcctcgatctcgcagagcacgcccttgggcagctctcgcacggccacgcagctgcgggcgggcttggaggtgaaatacttggcgtacacctcgttgaaggcggcgaagtcgcccatgtccgccaggaaacaggtggtcttcaccacgctctctagagtgacgccggcggcctccagaatggcgcccacgttcttgcagctctgctccgcctgtgcggcgatgccctcggggatagcgccggtggcggggtccacgggaatctggccggaggtgatgaccaggtcgccgaaggcgtagccctgggagtaagggccgatggcgcccggagcgttgggggtggaaatcacggttttcatgggaaaaccctcctttgatcgatttggataccttcatcataacatccgccgcagaaaagtcaactaccggcgcttgtgaaaaagggaaaatcgtggtatacttttttggaatgtcttacaggaagggcggacggcccgccggaaggagaagagcaagtatgagcgatttgagggaagtccttcaggagaacagctatctgcgccagaagcagctgatcttcgcggactgcgaccggtaccagcgggcccgggtgagcacgctgttgagcatcgccgccgccgtggccggggcggactacgacgcccggggtctgacctatgagaagctctatgagatgcgggaggtgttcctgctctcccgcatcgccctgcggatccatcgctgccccagggcgctgcaggtggtggacgtcaccacctgggaggacggcgtcaaggccgcccacatgcagcgggtgtatgagatcacggacagggagggacttctggtgtccatccgcagcgactggattctggtggacccgcagacccggcgcatcatgcggcccggcaccttcacagccaagaagctgggcacctgccccaaggccatcgacgctccggagccccggaagatcctgctgccccgggagggggttgaggatctgggcgcccggaaggtggtctggtccgacctggacggtaacggccatgtgtacagcggcaactacggtgacttcgtctgggactacctgcccgccgacctgcaggaaaaggtgccccgggagttcttcatcaattacagcaaggaagccaccctgggccaggagctgcggatggtgggctgccgcaagggcggcgagtatctgatggagggcctgggcccggagggcgtctgcttctccgcccagtgcgtgttttaagatgcgggcggagccgttttccctgggcgggatgccggccctccgctgggggcggcccagccggcgggggatcctctacctccacggccagggcggaagcaaggcggaggctgcgttctttgccgccgcggcggcggacgccgggtggcagaccgtcagcgtggatctgcccggccacggggaccgggagtcagaggccgcggctctggtcccctggcaggtggtgccggagctgcggtgcgccctggcggagctgcggggcagatgggaccgggtggggctcttcggctccagcctgggggcctggttcggcctgctggcatatccggacgcgcccctggcgggggcgctgttcctctctccggtggtggacatggaggccctgatccgcaaaatgatgggctgggccggtgtcagtgaggagcggctggcccgggaggggcgcatccccacaacgttcggccagaccctctcctgggaatatctgcgatacgtccggacccaccctgcccgccggtggcggacgcccacggccatcctgtacggcgcccgggaccatctgacggaccgggagaccgtggaggcctttgccgcccggaatggctgccgcctgactgtggaggaggccggagagcactggttccacacgccggagcagctggcggtggtggaccgctggcagcgtgcctgcctggcggacctggaataagagaacagcgaagcgccgccccgcatccgcggggcggcgctgtgatttgaagcgggagcagagctcagaacccgtacagcatggagcggctgatgtccgccagggagtgggcgccgcacatagccatggtgtcggccagctcggccttcagcttttccacataggtcttgacgccctcggcaccggcaccgtacaccatggtgacgaagggccggccgatcagcaccgcgtccgcgcccagggccagggccttgaacacgtccatgccggtgcggatgccgccgtccaccagaatggtcatccggccgcccacagcgtccacgatggcgggcagcacctctgcggtagaggggcactgatccagcacccggccgccgtggttggacaccacgatgcccttggccccggcctccagagctttcttggccccggccacggtcatgatgcccttgacgatgaagggcttctccgccatggcaacgatctcgcgcagctcctccacagtcttgctgccggcggggggcgtcatgttcttcaggaagggcaggcccgccgcgtcgatgtccatggcgatggcaaagggatctgcggccttcaccaggtccatcttctgccggatggtctccaggttccagggcttgacggtgggcacgccgcagccgccgttcttggcgatggccgccgcagcgccctccatgaccgcagggtccgtgccgtcgccggtgaaggcggcgatgcccgcttcagcacaggcggccaccaggatgtcgttataggccagatcgttgtacttgtccccgtagtggagcgtcatggcgcccaccggggcagcgaagaccggcaggtccaccgtgcggccgaacaaggtgaaggaggtgtccaccggcttgttctcgcagatggtgtccatgttgacgcacagctcctgccacttctgatagttacggatgaagccggtcccgatgcccttggcgccggggccggggacggtgttcctgcaggccaagccgttgcacacgggacaggccttgcagtaggggcccatagcgccccgcgcttgttccagaacttcctgatatgtcatagattttcccctccgaattgttttccgaaaaccgcggcacgccgcggaaggctgccttgattgtactccctttaaaagaaaaaggcaacctttggcagagaagttcccgggcgcaaaaagaggctggaaaaattttttgttttcctgcaacatacggcccgcctttccgtctgaataggcagaggccccggtttggaagcggggcgtgaaaaggagggtattggaatgaaaagaggctttgcgtggctgctgacgctgctggcgctgctgggtctgctgtccggctgcggcggtggtggtgatacgactgtgtcggacaccgcctccaacagcgccgccacggatggggcggacgacccgggcggctcctacggcgcctgggcggaggcggaagtggctgaggactccggcggtacggcggaggacggtgcctccgaccgtctggaaaacgccaagatgatctacaccgcccggatggaggtggagaccaccgccttcgacaccgccgacgcggacctgcggacgctggtggaggtcctgggggctattttgagcaggcggcggtccatgactacggcagcggctatcgctccggcgactacaaagtgcgcatccccgcggatcagttccagcctttcctggaccgggtggggacactgtgccacgtcacctatcaggagcagaccagcgagaacgtcagcgaggcgtactacgacgcggagagccgcctggccactcagaggaccaagctggagcggctgcagaacctgctggcccaggcggagaatatggaggacattatcaccatcgaatccgccatctccgacacggagctggagatcgagcggctcaccggcaccctgcggcagtatgacgccctggtggactacgccactgtccatctctccctccaggaggtgtaccagctctccaatgtggaggagccggctaccagttttgcaagccgcatgggcgcggcctttgcttctggctggcgggggtttgtgggcgcactggagagtctggccgtggccctggcctacggctgggtgtggctgctgcttctggcggcggttggcaccgtggcgggccgccttctctggaagaggaggcgcagggagcggcaggccgcctccaaggagtcggagaacaagccgtaagacagaacggaacaaacagcgcatccggcgttggatgcgctgttttcctgccggatttttgaaaatgatgtggatttttgacggatgatattccgttttgtgttcgctgtcgggcatacaccgcgccgccgcggcacatactagcggggatcacggaggtggagcatgaatcggatttcatccaattatgaggaaaatgtgcaatggttcaacgacgtgctaggggcaggccgcagctgcgacatggtatgtcgggacctgtatgtgggcggccggcgggcccggttctgggtcatcgacggcttcggcggggacgccatcctggagcggatgggggccttctggctgtcgctccagccggaggcggtgcagggcctgacggagatgcagcagttcgcggaccgctatgtgacctttatggaggtgaacgtcagctatgaccgggatgacatcgtcacctccgtgctgatgggcaaaagcctgctggtgatggaggggctgtccggcgcggcgctgatcgacgccaaggagtatcccagccgcagcgtgggagagccgccggacggcaaggtcctccggggctctcatgacggattcattgaggcggtggtgcccaacatggccatgctgcgccgccgcatccgggatccccacctgaccatggaggggctgaaggtcggccagcggacccacagcgacgtggcgctgtgctacctggatgaccgggtggaccacgccctgctggacgagctgcgccacaagctccagaacatccaggccaactccctcaccatggcgcaggagagcgtggcggaggccatccgccccaagcagtggtacaaccccttcccaaaggtgcggtacactgagcggccggacaccgccgccgcctgcgtcatggagggcagcatcatcctgatggtggacaactctgcggcggtgatgatcctgcccaccaccttttttgactttacccaggaggccaatgacttctattttcccccgctggtgggcacgtatctgcgggtcctgcgggtgacggtgttcctgatctccctgctgattacccctgcctggtacctgatggtcagctcgccggggcgcctgccgtcctggctggatttcctctcctccccggagccggcggcgctgtctctgctgtcccagctgctggtggtggaattcctgatcgacgtgctgaagctggcgtccctgaacacgccggatacgctgtccaactccttctccatgctgggggccttgatcctgggtgattttgccgtgcaggccggatggctggggccggaagtactggtgtatatggcattcgtctccgtggcgggcttcgcccagcccagctatgagctggggtacgccttcaagctgctgcgggtggcgctgctgctgctgacagcggccttcgacgtctggggattctgcctggggttcgtgggcatcctagtcctgctggccaccacaaaacccctggtgggccacgggtatctctatcccctgatccccttcaacggcaaggcgcttcgccggctgctggtgcgggaacccatcaatcgggacaacacctgagagacccgctccttccagcacgcgccggacaggattctgtccggcgcgttttttccccgaaagcagaaaatttttcaaactgtggcatttccaaccccttttggaaaaaatgggcgctctgatgaaacggactgcggggacaaaagcccaccctggtgcgtttgacgaggagagaagggactcatatcacggatcatcatgaacttctacaccccttcagctttggatggaggggaaatttgaacaggcgggagagatgcagccggcggagagaaatgaggggccgccacagctgctccggtggccggacggcccggctgccgtctttgcagccgcgctggagacggccgtgcgtgcctgcatggcgccgcccggcggggggaaactgtttttcgccgacttgacgaaatttccggctgttttttcgctctcctgcccaaaacggggaatgtgccaaaatttttgttgtattgcaccggcaaaggttgtataatttctacattaggcatccccggcggccggtgggactggccgcggcaacagcacaacataaggagtggaacaaacatgagctattctgtacaaaacatccgcaacgtctgtctgctgggccacagcggaaacggcaagaccgccctggcagagagcctgctgtatatgaccggggccatcgaccggatgggccggggcgcggacgggaatacggtctgcgactatgatccggaggagaccaagcggcagatctccatctccaccgctgtggcgccgctggagtacaaggggtgccggatcaacgtgctggacacgccgggcgcgttcgacttcgccggcgaggtgatcgaggctctacgggccgccgacgccgccatcatcgtctgctccgccaaggacggcgtgtccgtgggcctggagaaggcgtggaaatactgcgaggagcggaatatgccccgctttatctatatctccaagaccgacgaggacaacagcgactacaacgccaccttcgaggctctgcgggcccggttcggcaacaagatcgcgcctctggtggtgcccatctgggacgagggcaagaaggtcaccggcatcatcgacgtgctgaacaagcgcgcctatgagatgcaggaccaaaagcgggtggagatcgagatccccgagggcaaggacgccgtcatcgaggagttcaacaacgccctgaaggagtccgtggccgaaaccagcgaggagttcatggacaagttcttcggcggcgaggacttcacctacgccgagatgattcagggcctgcgccagggcgtgcgggagttgagcctgttccccgtgctgtgcggctccgctgtcaactgcatgggcagcctgatgctgctggacgacatcgtggacctgctgcccaaccccatggagggcaactatcacaaggccacccgccaggacggcgagacggagccctttgtggtctcccccggcggcgtgcctacggccttcgtgttcaagaccgtctctgaccagtacggcaagtacagcttcgtcaaggtgctctccggcaccctgacgccggatctgcccatggtcaacgcccgcaccggcgtctctgaaaaactgggccgcctgtacaccatgcggggcaagaaggccaccgaggtgaaggagctgggctgcggcgacatcggcgccatcggcaagatggagaaggtcaagaccggcgataccctgtgcgacgcccggaaggtcgtcgccctgaaggaactgcccttcgcagagccctgctattccgtggccatcgtgcccaagacccggggccaggaggacaagatcgcccagggcctggcccgtatgaacgaggaggatcccaccttctccgtcaccaacaacgccgagacccaccagatggtgctcaacggctccggcgacatgcaggtggatgtgctggtcagcaagctgaagagccgcttcaatgtggaggcggatctgaagcccgtgcgggtgccctatcgggagaagatccgcaagactgtccagaagcagggccgccacaagaagcagaccggcggcagcggccagttcggcgacgtgtggatccggtttgaaccccagacggagcaggacgacatgatcttcgccgaggaggtcttcggcggcagcgtgcccaagaacttcttccctgcggtggagaagggcctgcgggaggcctgcgcccacggtcccctggcgggctatcccgtggtgaacctgaaggccgtgctgtacgacggctcctaccatccggtggactcctccgaaatcgcctttaagaccgcggcgcagctggcctacaaggccgccctgccggaggccaacccggtcctgctggagccggtgggcgagctgaaggtcactgtgcccgacagctacatgggcgacgtcatcggcgatctgaacaagcgccggggccgcgtcatgggcatggatcccaccggcgacggcaaccaggtgatctctgcggaggtgcccatggctgagatgggcagctacgccatcgatctgcggtctatgacgcagagccgcggcagcttcaccttccacttcgtccgctacgaggactgcccgccggcagcccaggagaaggccatcgcggaggcgaaggcgctccaggcggcggaggagaagtaaggaagaggcagtccgcgtctctccgccgggagtccggcgtacaagtattttgccggaggcaaaatcttgaaatcggccgaattcacttcgggcgatttgcatccaatgcggggtccccgcggggcgcaaagcggcttgcggggcgactgcccgccggcagcccaggagaaggccatcgcggaggcgaaggcgctccaggcggcggaggagaagtaaggaagaggcagtccgcgtctctccgccgggagtccggcgtacaagtattttgccggaggcaaaatcttgaaatcggccgaattcacttcgggcgatttgcatccaatgcggggtccccgcagggcgcaaagcggcttgcggggcgactgcccgcctgcggcccaggagaaggccatcgcggaggcgaaggcgctccaggcggcggaggaaagataacgcacatttgcaaaaaccaaaacggcggggagcaaactccccgccgtttctgtaagcagaaatgccacaagctgttaatttgtatgaaaggagcgggcacatgtatcaatataaatacattccggtggataccggcggcggcttcctgtcagacacccgggaacaccgggagcttatcgacgcatacgccgcagaaggctggcggtatgtgggatttttcccggtgagcttcacgagtcatggagggattagccgggtggacctgatctttgaacggagtcgtaaattgccgacttaaaatccaggaaaagttttctattagttgcaaaagcaacttcaaaatattagaatatcctgttatactcaaactgtcccaaggggactgaggaaaaaaggctttcaaaaaagataagtataaaaggaggacatttactatgaagaagtgggtctgctctgtctgcggttatgtttatgagggcgagaatccccccgagaagtgcccccagtgcggtgttcccgcctccaagttcaccgagcagaagggtgagctgagctgggctgccgagcatgtggtcggcgtgggcaagtccttcggcgagtctgttcccgccgaggtccagaaggagatcatcgacggtctgaacgccaacttcaccggcgagtgcactgaggtcggcatgtatctggccatgtcccgcgtggcatatcgtgagggctatgccgagattggtgagtattggcgccgggccgctctggaagaggccgagcacgctgccaagtttgcggagctgctgggcgatgtggtgaccgactccaccaagaagaacctggagatgcgggtcgaggccgagaacggcgccaccctgggcaagttcgagctggccaagctggccaagcagtacaacctggacgccatccacgacaccgtgcatgagatggcccgcgacgaggcccgtcacggcaaggctttcgagggcctgctgaagcggtacttcggctgattcgaaaagtccatacggcaaatcccccggccgccggccgggggatttttataaaaagagaggtaagaccgttcgcgccgcacgaaactaatcagaatctgtaacatctttcaaggccctgaggggcgcttgcttttctgctcccatatacatgaactgatgttggttgatctggtcatacatcaatttcggttaacatgcaggcagaaagagaggcttgcgtgtgatgatctcctatgacagcctgcgggacaaaatgaaggaaaaaggcatctctcaatacgccctgattaggcgctggcacatcaatccagcccagatcacccgcctgaagcggaatgagagcgtcagcccccacaccattgagatgttctgcaagatcctgaagtgtgaggtgggggacattatgcggcatattccggacgggaaagcgtaacggcagagcaggccgcccgctctgccgttttttgccgtccccggcccgattctacgctccgcagacaaaattcaagggcgggggatggtcaaacagcctgatttgcggtatgctgaggccagagaggagggaggcccatggatgccggaaagacaggcgcctatctggcggcgctgcggaaagcccggggcatgacccagcaggaggcggcggatcagctgggtgtctccaacaagaccgtgagcaagtgggaaaacggcgcggggctgccggatatcaccgtgctgcctgccttggcggagctgtacggcgtcaccgccgatgatatcctggcgggagagaccttgcggggccggccagcggaggcccagggaccggcacggcggcgcctcctgctgctgcggctgcggacccggttcgacctctgtttcatcggcagcctggcgctgggtgtgctggcggcattccgggtggcctatgtcagtctggcggcctggccgctgtcggtgggcctcttatggatcggctatgtgctggctgtccatccggcccggtacggtgatatatcgttggatgctaaaatttgggaaaacctgtaccgcaagctgctggccgcctccgccgtccagtggtgggccctgctgcggctggtgcggctgggcaggctggaggtggactttgcggagatgcggtactacgacaccatgcaagcctggaagccgctgctcttcgccgtggggctggcgctgctgtgcgccgtgctggagcgggccctgcgccgccgggcgggggcggatgcctctttgctgtggataccggagcggctgcggccaatgctccaccggagcggcggcttcctgcggcggacccggcggctctggctggtgtggctggcgtgggcggtacttctggcggggctgtggttcctggcggacggccagctggaccgggtgttggcgccctggatcgcccgatatggggaagagctggtccaaagcggtttcccggagagctggaccatcctgcgggggcggctggaggcggatgtggcactctggctccggctgcggcagggggtgctgatcgccggcgccgtctccggggctggcgtgctggtttggacgctgctacattggaaaaagcgccgcccccctcttgcggaggagggcgaaacatgatagaatctctccggcgaagaataaggggagaagtgtatgtatcactatattttctttgatttggacggcacgctgacagactccaaggagggcatcctcaacagcctgcggtatgcctttgacaagctgggggagccggtgccgccggagagcaccctcatcaaattcatcggcccgcccctgcaggactccttcgcggaattctgcggcttttcggcggagcgggccgcggaggccatcgccgccttccgggagcggtacgagcctgtcggcaagtttgagaacatggccgcccccggcatggcggacctgtgcgcccggctgaaggcccggggctatgtgctggctctggcctcctccaagccggagagcctgtgtgtgcccatctgcgagaagttcggcttcacgccgtctttggctgttgtgacgggcagcccgcccgtgggggactggagcaaggcggacgtgatccgggagactatgcgccgcctggagctgacggaggcccacaagccggagatcctgatggtgggggaccggaagttcgacgtgctgggcgccaaggcgtgcggcatcgcctgcgcgggcgtggagttcttcggctacgccgcccccggcgagctggcggagagcggcgctgtggccgtggtccggacaccggaggagctggagcagttcatcctgacccattgaatgcgaaaaaagaggcggcgcccatggggcgccgcctctttcaggcgcttcggtattcagccgacggtttccgcctcgaggacttccggcagggtcaggccctcaccagtgagatcggcggtgaggatggggtcgatgggcaccgccagatacatactattgccgtagacataggcgccggaggtaacggctaccgcctgaccgtagacgttcagcagggcgccgccgctgctgccctcggagatgtcggcggtgctcatgacgcagggcagggcgtaccgctccacatcccgctgcgtggcgctgacgatgccggagctgactgccagccccaggcccaggggattgccgatggcgtagaccgtgtcgcccgcccgcaggtctccggtgccggaatccgcgatgtccagcgtggcaaaagcagaggtgtcgtgtccctttagggcggcgtgggagacgcggatcaccgcgatatcgatgtccggatcgtagtagatgacccgctccacctcatatacatccccggtggagagcgtggcggtggcggagaccgcgtccgcgatggagtggtagttggtgatggccagcccgtcctccgtgatgaagaagccgctggcctcgccggtgacaaggccttcgtcccggtacgcctccgtctcataggtgtccagacggaacacggcggccgcgcagcggtccgccacctgccgggcggtgagggcgggggtcagcaggcccagggcgttggccgcggcccgggagacggtcccctggctcaccaggcgcccgatcactgtggcgctgccgtcccggtaggagaaggacagggcatccgccgccatctcaaacaggtcccctgggtcagggtgccggtataggcgatggggaagaggccgatccgctgggcgaaacccgcggcgtcggcaatggtaaagtcgcccgccttgtcggaataccccagcatccgcagcaggaaggcgctccaggcgttggcggtgagggccgcgtccggccggaaggctgtcgccgtgacgccggtgatccagccctgccgggcggcgtagttcacctcctgggcgatggaggcgggaacatcccggaagccggccagccagttgtctgccgcggcggcctgttctgccccggccagatgcaccagcagcacggccgcctgtgcccgggtggcgggggcgtccagattatatgtagagtcgatcagtcccagggtggagagggtgtccgcggcccgggccgcctccccctccagagcggaggcggcggggatcacgctcaccgtcaggacaaggacacagaggagcgaaagaagtcgttttttcatggggtagcctccaaatcttgagaatggctccattttagcaccgggcagagcgcttggcaaggcccggtccctttactgcccgggccgatttgggcgttcccaagactctcttggcggaaaagacggaacagaacggtatataaaaggccccgctgccgcacatgagggccttggttccactattctgtatattgggatcacgctcttctgcccttcagaaaagaacgcatcagcatcgcgatcatgccaatcatgagatagcagacgcaatacaacaaaaacgctgtttcacccatcgcaaagaatagccacgcccctgccagaaataatcccgcgacaacaattggaaggggccacagccgcttgatgtcctttcctgcaaatacgccgcatacagcagaaaatatgggattgaccccaaagaacagcagaaggcagacggccattcccgcgctgcctgcaaatgttgctgccaaccacggacagcctatcatcaacagcattgccaatatagaccagaagatcaatggcttcatgtggatggcctcccttttatacggaaatggttgcttttctatatgatatcatatacgtctggctgcttcaaggtttggaagcgggccccttcagcgaaagcgccggagctgcccatccgtccggaggaggcgggggagcaaggcccgtctcactggacaggcgggccaaagtctgctatactgaatctaccttttggaaaggaagcggcccatggcggagcgattggcggaggacctctggcggctggacatccccttggtggggaacccgctgaaaaacttgaacagctatttgctgaccggagagcggagcctgctgatcgacacgggcttccgccagcagtcctgccgcgaggccatggagcgccagctggcggagacgcacgtggaccgggaccggctggacattttctgcacccacctccacagcgaccacacagggctggcgccggagctgatccgccccggctgccggatctatatcggggagatcgacagccccggcgtgaaaaacgcctcggatccgtcctgttggaagcggctttacggggaatatgtgcgggacggcttcacccaggcggagatggaggccctgtggggagacaatccggcccagacggcggccccgccctggcgggaagggctctatacggagctgcaggacggcgcggcgctccattacggcggccgtatgctgcggtgcgtgctgacgccgggccacacgccggggcacctgtgcctgtatgacccggcccgccggcggctgttctgcggcgaccatgtgctgtttcacatcacgcccaacatctgccgctggcagggagtggaggactctttgggggactatctcagcagtctggacaggacggccgctctggacacagcggagctgtatcccgcccaccgggcggagaccggggacctgcggcagcggacggcggagctgaaggcccaccacgcccgccggctggaggacaccctgcggaccgtggagaaggcgccgggcctcaccgcctatcagatcgcaggccggatgcgttggagcatccgctgccggaactgggcggattttcccctggcgcagaagttctttgccgtgggagaggccctggcccatctggaccatctggaggcccaaaggcgggtcttccgccaggagatacatggaaaacgggtatatttcgccggcgtgggcgacaaaatatgaatgataaaggagatgcttcaaatggaagtgaaagagattctgagcaagtgcgaccacactctgctggcccaaacggccacctggaaggagatccaggccatctgcgacgatggtatgaagtacggctgcgccagcgtctgcatccctgccagctatgtcaagcaggcggcggagtatgtggcgggaaagctgcccatctgcacggtgatcggcttccccaacgggtatgacaccaccgccgccaagtgcttcatggccacggacgccgtggagaacggcgccgaggaggtggacatggtcatcaacctgggctgggtgaaggatcagaagtgggatgacctgctcgccgagatcaaggccgtgaaggccgcctgcaagggcaggctgctgaaggtcatcatcgagtgctgcttcctcacagacgaggagaagatcaagatgtgcgagatcgtcaccgcctccggcgcggagtatatcaagacctccacaggcttcggcaccggcggcgccacccgggaggacgtggcccttttcgccaagcacgtgggccccaacgtgaagatcaaggccgccggcggtatcgccgacctgaaggacgcggaggacttcatcaacctgggtgcctcccgcctgggcaccagccgcatcgtcaaggccgtgaaggccatggaagagaaataaggaggaaatgaaagcatgggaactccccataacgaggcggcccagggggcctttgccaagaccgttctgatgcccggcgatccgctgcgggccaaattcatcgcggagacctttctgcaggacgcgaagctggtgaacaacgtccggggcgtccagggctacaccggcacctatcagggcacgcctgtgtccgtcatggcctccggcatggggatgccctccatcggcatttactcccatgagctgttccacttctatgatgtggacaacatcatccgggtgggcagcgccggcgctatctccccccagctgaaggtgcgggacgtggtgttcggccagggctcctgcacggactccaactacgcccaccagttcggcctgggcggcaccttcgcccccatcgcggacttcaccctgctggagaccgccgtgacggtagcccggaagctcggcatcgagccccatgtgggcagcctgctcagctccgacgtgttctacaacaaggcgggcaacactctggactggggcaagatgggcgtgctggccgtagagatggagagcgcggccctgtactgcaacgccgccgaggcgggcaagcgggccttggccatctgtaccatctccgacagcttgattaccggcgaggagctgcctgccgccgaccgccagaccaccttcacccagatgatggagatcgccctgggcgttgccgtggaaatggcgaagaagtaaggcgagttcaaaaaagaagaatcagtccccgcggccacgcgggggaagcatgaagggggacgttgagtcccccttcatagttgatcggcccgccgcagcggcgactttcggcaaaggtgaaagcgggaggcccgccggcaaagccgccgggccgggacgcggagcatcttttccatattttcccggtccggcacaggccgagcctctccgggaaatgaccggtgacaatggaaacagagccgtgacaaaccacagcaaaaattttgcagaattggttctgctttttacaaaaccgtaaaaaagatatccgaaattcataaaaatttcaacaaaatgtggcgaaaaagaaaacaatttggaaatgcggttgcaatcctcaggaagagttgttataatgggcctgacccgttgaggtcatcctgcgcggagagattttcgcgcggataacaaaacgaaggaaggtagattccaatgaagaagtttcttgcattgctcctggcattggtgatgtccctgtccctggtcgcctgcggcggcggggacgacaccgccgctgacgggggcgccgatgcggaggatggcggcaacgccgagaccgccgcttatcaggtggctatgattactgactacggcgatatcaccgaccagtccttcaaccagaccacctatgaggcctgccaggagttctgtgacgccgagggcctgcagttcgagtactacaagcccgccggtgactccaccgccgagcgtgtggccatggtggacgccgctgtggctgacggctacaacgtcatcgtgatgcccggctacgcctttgccgagaccatcaaggagaccgcggagctgtatcccgacgtgaccttcatcgcgctggacgtggcgcagggcgatctgggcgaggactacaccgtgccctccaacgtgtactgcgctgtgtatcaggaagagctgtgcggctacatggccggctacgccgccgtgaagctgggctacacccacctgggcgtgctgggcggcatggccgttcccgccgtgcagcggttcggctatggcttcgtgcagggcgctgacgccgctgccgtggagatgggcatcgccgaccaggtcgtgatggagtatgcctatggcaaccagttctatggcgacagcgatatcaccgcctacatggacaactggtatcagaccctgggcgtggaggtcgtcttcgccagcggcggcggcatctacacctccgcggctgaggctgctgccaaggtcggcggcaagctgatcggcgtggacgtggaccagtccgccaacatcgacacctatggcgagggcatgtgcgtgacctccgccatgaagggtctggccgagaccgtcaagcacatgctgggcgaggtcgtggcaggcaactttgccaactacggcggccaggtggagaccctgggcctggtgaacggcgatgatcccaccgccaactatgtccagctgcccatggagaccacccagtggggcgacggcttcacccaggacgactataaggccctggtgaaggccatgtacgacggcgatgtcaccgtttccaacgacatctccgccatgcccgcaaccaccatcacggtgaactttgccggcaacatcaagtaaggatcagagtctttgcaggaagaggacgggagcaatcccgtcctctttttttgcctctggacaaattttacaaaacaaacctgatattcctgcattttttctttgaaatattccggaagatatagtacaataaatacactatacaagaggaggagggcggtaagcttggaacagccatatgccattgaaatgctgaatatcaccaagcgctttccgggaattgtcgcaaacgacaacatcacgctccaactgaagcggggcgagatccacgcgctgttgggagaaaacggcgccggaaagtccacgctgatgagcgtgctgttcggcctgtaccagccggaggagggcgtcatcaaaaaagacggccaggtggtgcagatcaaggacccgaacgatgcaaacgcactggggatcggcatggtccaccagcacttcaagctggtggaatgcttttccattttagacaacatcatcctgggcgtggaaccctgcaagaacggcttcctgcagaagcaggaggcccgggagaaggtcctggccctgtcggagaagtacggcctgcaggtggacccggacgcactggtggaggatgtcaccgtgggcatgcagcagcgcacggagatcctgaagatgctctaccgggacaatgagatcctgatcttcgacgagcccaccgctgtgctgacgccgcaggagatcgacgagctgatgcagatcatgaagaacctggcggcagagggcaaatccatcctgttcatctcccacaagctgaatgagatcatgtccgtggcggaccgctgcacggtcctgcggaagggcaaatacatcggcacggtgaacatcgccgagaccagccgtgaagagctgtcccgcatgatggtgggccgggacgtggagttcgcagtccacaaggagccctccaagcccaaggatcccatcctggtggtggagggtatgaccgtggcctccaagctccataacaacaatgctgtgaagaatatctcctttacggtccgggcgggagagattgtctgcattgccggtattgacggcaacggccagacggagctgatctacggcctgacgggcctggagcccctggagtccggcaagatcacgctctgcggccaggacatcacccgcgcccccatccggcagcggtctctgctgggcatgagccacattccggaggaccgccacaagcacggcctggtgctggactacaccctggaggacaacatggtgctccagcggtactttgagcctcagttcgtcagcaaggcgggcttcctgaagcgcaaggccatccgcgagtacgccaaccgcctgatcgagcagtacgacgtccgctccggccaggggcctgtcacagtggcccgcagcatgtccggcggcaaccagcagaaggccatcatcgcccgggagatcgacaaggacccggagctgctgatcgccgtgcagcccacccgcggcctggacgtgggcgccatcgatatcacaagcagatcgtggcccagcgggacgccggcaaggcggtgctgctggtgagcttggagctggacgaggtcatgtccctgtccgaccgtatcctggtgatctatgagggcgagatcgtgggcgagctggaccccaagaccaccacggcggaagagatgggcctgtacatggccggcgccaagcggaagggggcttgagaaaccatgagacaagaaaaatcatccctcctgcggaacaagggattccagtccctgctggcatccctgctgtgcatcgtgctgggcctgctgatcggctatatcgtgctgctgattatcaaccccgccggcgcgggagaggccatccgcaccattgtggagaacttcctgtactatcccagcgccgcggcccggctgcggtatctgggcaacacgctggtgaagaccgcgccgctgctgatgtgcagcctgtcggtgctgttcgcctataaggtgggcctgttcaacatcggcgccgccggccagtacgtcatcggcgccggcgccagcctgtactgcgccttgggcttcgggctgccctggtacgtgtgcctgttggcggctattgctgccggtgcggtgctgggcgccatctccgggctcctgaaggcgtaccgcaatgtgaatgaggtcatctcctgcatcatgctcaactggatcagcctgtatctggtgaacgccctgctgtcccaggtgaaggagacagccagtccctacaccttcaccctgagcagcacgaatcccgacgccatcctgccctctctgggcctgggcgccctgttctccgacaaccagtatgtgaccatcgccatccccctgacggtgatcgtggccgtgggcatctgggtcctgctggagaagaccaagctgggctatgagctgcgggccaccggctgcaacaagtttgcggccaagtactgcggcatgaaggagaagcgaaacatcatcctcaccatggccatcgccggcggccttgccggtatgggcgcggccacgctgttcctcaccggattcgagcagtggcaggtcacacagtccgcggtgccggccatgggcttcaacggcatcgccgccgccttcctgggcggactgaatcccatcggcgctatcttctcctcgtatttcattcagcacatcaccaacggcggcgcgtatgtggacaagaccatgtactccgcccagatctctgatctgatctccgccctgattatctacctgtgcggcttcgtactgttcttcaaggtctttatgaacagccggctggaccggcgggatgaaaagcggcgggcaaaggaagaccggcccggctctgaggaaggagggaaggcgtaatgttactgctgctgcaatacacgctgattttcgcctccgtcctgctgctggtggcgctgggcggctgcttctctgaacactccggcgtcatcaacatcggcctggagggcatcatggtcatgggcgccctgggcggtgcgctgatgatgaagttcctgcctgcaggcacctccgcctttgtggtggtgctgttgacggtgctggccagtatcctgctgggcatgatctactccctgctgctggcggtggcggccgtgaacttcaaggcggaccagacactggtgggcacggccatgaacctgctgggcaccgccgcggccaccgtgttcgtgaaggccatgaacaccgccgccgatccggacaacgtgtcctccaccatccagtacctggacggccgcaaggcattcctggtgaacatcggcggctttgagttcaactggtgcatgctgctggcggtgatcgccctggtaatcgcctatgtggtgctgtacaagacccgcttcggcctgcggctgtgcgcctgcggcgagcatccccaggcagcggattccgtgggcatcaacgtctaccggatgcgctacgccggcgtactgatctccggcgtgctgggcggcctgggcggcattgtgtatatcatcgcgggcgtcagcgagtggaagtttgaaaacggcgtggccggtttcggcttcctggccctggcggtgatgatcttcggccagtggaagcccacccgcatcgccctggcggcgctgctgttcggcttcttccgggccctgggcaatgtgtacagcggcttcgacctgctgagcaatctgaacctgcccagctccgtgtataacatgctgccctatgtcatctccctggtggtgctggccttcacatctcagaagtcccgcgcccccaaggcggagggcattccctacgacaagggccagcggtaattccatcacaaaacggaatttcacgacaaaatatgcctccctgttatcggcttcgacaacagggaggctgtttttatcccagcacgtagcccaccagcaaagcggccagcagcagggagaaggcactctgcaccaccttgcccaggaagcagttccgcagccgcaggccgctgccctccagcaccgccagcgtctgacacaggaccgagaggccgccccagcccgctgctgccgccgccagaagaaagccgaaggcatcagctgtcagcagtggcgtcagggagaagagctccagcgccgccaccaggaccgcccccaggcggccgcccacggcggtgagaggctgcgccagcacatagaagaacaccacgaaggcgcacacagacagaatcccggcaagcgaggaccggacagccccggtgaaggcctccgcaaagctgacagcccggaaaggaggacgccttgtcagctcctgccgggaagcggattttccgctgccccgaaacaccagtcccgtcagaagggcggagagcacatggatcagccacagccacaccccggcccgcacactgccgaacacccccacgcccagcacactgatgaggaacaccggattggagttgttgcagaaggccagcagccgctccgcctcctcccgggagaccagattttcccggtagaggtctgctgccgtcttggcgccgatggggtagccccccaccaaccccagcaccagcgcagcactgccagcaccggggacccggaacagcggctccatcagccccgccagccagggggcggccagctccccgaaccccagagccagcagcgctgaggaggccaccaggaaggggaacagggaggggaccacggaacgggcacagagggccaaagcttccgccacactgtcccgcacggccccggcgtccgccagaaaccacaccagcaggccgccgaggcacaggcaggccagtatccgccatcgaatccgcatcccgcatcacctctccacaccctatgccggagcgggggacactatgcccccggcatgttgcgggacgtttgtgcatacagtcgggaagaggtgaacgtatggagcggaatcgaaaggaccgaaacggtggcgtgctggacacggtggcggagctgttcgacctgccggcagatctggtggcgggcctgccccacctggagatgatgggcagccgccagctgtatctggagcaccacacaggcatcctggcgtacagcgacgagcagatcgacgtaaacaccaccggcggcgtgctgcgggtccggggcgcccgcctggccctgatggccatgacggcggaggagctgcggatcggcggggacattgccgccgtggagtgggtgaggtgacaccatgctgaatcagatcgtcaaccggctccagggccaggtccggatccgggtggagaccccctttccggagcgggtgctgaatctgtgcggcgcccggaacctggccttctgggatatggagtgggagtccgagactgccttcacctgccggctgaaccggcgggattactacgccctgcgccgggcggtgaaacagctggactgccggctgaccgtggtgcggaaggagggggtacccttcttcctgggccggttccggcggcggcacgcgctgttggcgggactgaccctgtgcagcgcactgctgttcttcggctccttcttcatctgggacttcacggtggaggggaaccagcgggtcacagacgaggagatcctgcgggcgctgcagcggcagggggtggggatcgggaccttcggcatctccctggacacggaggacatccgcaaccatgtgctgctggagattccggagctgctgtggatcacagtgaacgtctccggctgccgggcctatgtagaggtgcgggagcgggtggaggcgccggagccggtggacgagcgggagcccaccaacgtggtggcccgccgggacgggctgatcctggacatccaggcgatggatggggtccggtgcgtgctgccggggacgtcggtggaggcgggcgagctgctgatctccggcgtggaggacacggagaccgtgggcgcccgggtcctgaccggcatgggaaaggcggaggcccggacctggtacaccctctccacagtaatgcctctgacggtggcggaaaagcagtacaccggagaggagaaacagggctactccctggtctttgggacaaatcgggtaaaattctttttaaacagtagcatcgggacgggaaactatgataaaataaccgaaaggacccagtggtccctgttcgggctgccgctgccggtcacctttgtgaaggagacctttcgtttttacgagacggtccccgccgaggtctccgccgcccaggcggagagccggggtgaggcgatcctcacggactacctccacactctggtggacccctacggcaccgtcagctctaccctgtgcacttctcgccgggagggggacggactgctggtgacactgacggcggagtgtgtggaggagatcggccgggccgtgcccatctacacagaccccacagaagaatcgggcggctgatgcccgggagatacaggagtgataccttggaacagcgaatcagcattgagcggctggagcaggccgtgaatatttttggctcctttgacgagaacatccgcctgctggagcaggagttctccgtcacggtggtgaaccgggacggggagctccgggtggagggcgagccggaggacaccatgctggcctgcaaggccatccaggccctgctgaccctctcttcgcggggggaggccatcggggagcagaacgtccgctacgtcatcggcctggtgcgcagcggcaaggagtcccagatcaccgagctcaccggcgacgtactgtgcatcagcgccaagggccggcccatcaagcccaagaccatcggtcagaaggagtatatcaagtccgtcctgaagaacaccgtcaccatcggcgtgggcccggcgggcaccggcaagacgtatctggccgtggccgccgccgtgcaggcgtttcgggacaagcaggtgaaccgcatcatcctgacccgtccggcggtggaggccggcgagcggctgggcttcctgcccggggacctgcaatcaaaggtggatccctacctgcggccgctgtacgacgccctcttcgacatgctgggggcggagacctatcagaagtatttggagcggggcaacattgaggtggcccctctggcctatatgcggggccggacgctggacgacagcttcatcatcctggacgaggcccagaacacctcccgggagcagatgaagatgttcctgacccggctgggcttcgggtccaagatcgtcatcaccggcgacgtgacccagatcgacctgccggacggcaaggcgtccggtttgaaggaggccatgcgggtcctgcgggacgtggagggcatcggcatctgcgagctgaccaacgccgacgtggtccgccatgtgatggtccagcggatcgtggaggcctatgagcggtacgagaccgcgaaaaacggcggaaaggggcggaagtgatggcgaagcggcattatatccccgtcaccgccgacgtgcccggcgccgccagtgagggcaactgcgccctgatccgcaaggtgatccgcaccgccctggcggcggagggggtggacgttccctgtgaggtggacgtgctgctgacgaacgacagcggcattcacgaaatcaaccgggagatgcggcaggtggacgcctctacggacgtgctgagctttccggagttcgaccttcggcccggggagctgcccgcaccggaggacgcagacccgggcaccggcctggtgcccctgggggacatggtgatctccatggagcatgtggcggcccaggccagggagtacggccacgccaaacggcgggagctgagctatctggtggtgcactctgttctgcacctgctggggtacgaccatctggacgaggggccccagaaggcccagatgcgggcgagagaggaagccatcctgggggagctgggcatcgggcggtgaatcactcccggggcaggccccggccggtgcgcaggcccagcaggaaagcgtggatggcggtgaactccaggtttttttcatagctttccaaggcgtgataacccaactcgttatgaatcatatccatgtggaagttatagtcgtccgctgggacagtgtccaggtagggcttgatgtagtggagataaagccatatcataaagtctgacatagaaaccacctttcaaaaaacaccattttcactgtgctatgatgaaaagataacacagttaattcgcggtgtcaagaggaacaaaatgcttttgaaagaaagactgcgagaattgcgcaaggagaaaaaagagacacaggttcaggtagctgaggcgattgggattgttgagcagcactaccagaaatttgagggtggtgttaacctccccaacctggaaaacgcctggaagctggcggaccacttcggcgtcaccatcgactatctggtggggcgaagcgacaagcgggggtaacatgagatgggccgccgtcgcggcggcctcggggatctctgctcccgcagggggcttgtccggcgggatgcgccccccattctctttttggttgcgccaaaaagagaatgcgccgcgcccggtggaagagaaaaagcgcttcggcggggcggtctgcgccagcgcagacctcctgccgccggcgggggatggttggcactcccttgcagaagtcagggacggaaacgcaccgcccttggggaatccttaggcccggggaggttcagggatacccctgcttcgctttccgctgccgctcacgcttccgcggagaaccagccagcgcgtagcgacgcggaacgcgcgaaaagagaagctggtcaaatgcgatcttgcaccccgacgacctccgcaccatccgccacgggtcggcagttgggggaaccgcagaagacctaagcgtgcccgaaggctaggcaaaatcggagcaggcaccggtacgccgacccccgtcagcgcggagggccactgcaccggagcgcgtccaagcggccttttcttttggaccgtgcacggcccgttttcttttcggcaagaccgaaaagaaaatgggggtgcattgcccagctatcatcatagctgccattccgcgtccaatgggacgcaccccaaacactcccgccccggaacaccgaatctgccccgttgcatacactatcccgaggtgatttgggatgacattgctgcaagacggtttgatcgcgttcttctccgcggtgggcgtgaccaccctggtgtggatcgtggcaggggcctttttccgggcggggcggccggcggtgccggggctgctgctggtgctgcccctgcggggagaggccctggccatggaggcggacgtgcgggagctgcggcgcctgcgggggcgcctgcccggggccagaatcgtgctggcggactgtgggctaacccgggacgcccgggcgctggcggcctatctggcggaccgggatccgggggtggcgctgacggacggcgctgtgatccgtctggacgaaaacgagcatacgaaagaggaagagcatggaagagctggtcacctgtgagggaacggtacatagcatcatttttcaaaatgccgagaacggctatacggtcctgcgcctcctgacggaggagggtgaggtgattacggtggtgggctgtatcccctgcgtggcgccgggagagcacctggcggtctccggcgtgccggagacccacccccagcacggggaacagctccgggcggtggagctggagcggagcctgccggaggacgaggaggagatcttcagctatctctcctcaggcatctgcaagggggtgggccccgccaccgcgcggcggattgtggagcggttcggggcggagaccctggacgttctggagcgggagccggagcgcctgaccacgctcaaaggcgtcaccgcccgcaaggcccaggagatcgcggagagcttccgccagcacatgggcctgcggcggctgatggcctttctggcccagtaccagctgcctcctgtcctggctatggagctgcggcggcagtacggcgacgcggcgctggagaaggtgcgggagaatccctacctcctctccggcgaggcgtgcggggtggagttctccgtcaccgacgggatcgccatgggcatggggctggctgcggacagcgaccagcggctccaggcggcggtgacctttgagctgagccacaatgaaaacaacggccacgtgttcctgccccggaacaagctgatctccgccacgacccagctgctggacagcggggcggagctggtggagcaggctctggacagcctcattgaacggggcgcggtggtccaggaacaggtggcccatgtggaggcctgctacctccggcggctgtgggaggcggagtgttccgcctgcatccgcctggcggggctgctggctgcggatacagaccgcagtgcccaggcgggccgggcggtggacgagctggaggcccagcagggcatcacctatgcgcccctgcagcggcaggcggtggagctggccgcccggacgggggtgctggtcctcacgggaggccccggcaccggcaagaccaccacagtccggggcatcgtggccctgttccggcggatgggcctggagatcgtcctggcggcccccaccgggcgggcggccaagcgcatgagcgagctgaccggcatggaggcccagacggtccaccggatgctggggatgagctggaacgacgtcacccatcaggtgacgttccaaaagacggaaaaggagccgctggaggcggacgcggtgatcgtggatgagatgtccatggtggacctggcgctgttttccgctctgctgcgggccctgcggcccggcacccggctggtgctggtgggggatgcggaccagctgccctccgtgggggcgggaaacgtgttctccgacctgatccgcagcggcagggtggagacggtgttcctccgggaggtgttccgccaggcggagcagtcggccatcatccgcaacgcccacgcggtgaacctgggccagccgccccagctggccaacaaccagggagacttcttcttcctctgccgccgggatggggagcggaccctctccacggtggtggagctgtgcaaaacccggctgccggaccacatgggcatcccggcggaccagatccaggtgctgacgcccacccggaaggggcccagcggcacggagaatctgaaccgctgtcttcaggcggcgctgaacccgccggcggcggacaaacgggagatccagtggggagagcggctgttccgcaccggagaccggatcatgcagacgaaaaacaactacaacgtggtatgggaaaaggcggacggcaccgtgggcaccggcatgttcaacggagacgtgggaaggatcgtggagatcgacccgtccggagagctgctggtggtgaactttgatgaccggatcgccacgtacacgctggatatgctcaatgagatcgatctggcctatgccatgacggtccacaaggcccagggcagcgagtaccagtgcgtggtgctggcggccatgccggcagcgccgtccctgatggtgcggggagtgctgtacacggccctgacccgtgcaagagagcttctgatcgtggtgggggacgacgcggccatccgggccatggcggccaacgaccgtcagcagcggcggtattccggcctccggtggaggctggcacattttgcggatccggcggagagataaaggccgccaggtttgctgccggtggaggatggggtgcgtcccattggacgcgggacgggcagttatgctgctggctgggcagatacacccccgtttcccttttggaaagacaaaagagaaacgggggctgtatccctgctggaccagcccctgcgggagcagacaccccgaggccgccatccggcgtcccctgcgtatccgcccagccgtcatggctgagttttgcagatggaaactgacgccaacggtttcatagaacaggcgtgcaacacggacccatatgggtcccatttttttacctttcctccatagaataaagcaaaatcggaccgaaacaggtcctgttgcggaggcgtctatggaggagcagaagatcaagcaggacatccggattggagccaatattcggcggatccgaaaaaatcgaggcatcaagcccatggcactggtccgcctgctccagctggagggcgtggaaatcacccgggaatcgctggtgaagattgaacgaggggctcagcatatcaaggcttcccagctccggggtatccgtgacgctttgcataccacgtatgacgaactgctggcggaggcagagaaacgatgagcctgctgtccgccctcctggacctcatcttcccagccaagtgccccttctgcggccgtgttttggacagaccgggcatctgtgacacctgtcgcggggagcttccctggacggagggagccgacgccctgcgccgggggcccggcggctttctctgcgcggcgcctctgtggtaccagggcctggcccgagaggggctccaccgcttcaagttccgggggatgtcctctgctgcggcgcccctgggagagctgatcgccgggtgcgcggcggagcacttctccggagcgttcgacacggtgacctgggtacctgtcagccccaggcgcctgcgtcagcgggggtatgaccaggcccgcctgctggcggagagcgcctgccgcctgtgggagacgaagccgctgccgctgctgcgcaagaccgtccacaaccccgcccagtcgggactgaaggaagctgccgcccgccgggccaatgtgctgggggtctatgaggcggtggacccggagcggatctcggggcatcgtatcctgctggtggacgacatctgcaccaccggcgccaccttggcagagtgcgcccgggtgctgcgggaggccggagcggcagacgtggtctgcgccgcagcggccttgacgccgctggagagggacagcgggaaaaaggcctgaatcggtggaaattgttcacaaattagtgttgcattcccaggaaactgccagtataataaagactgtatgattgttcgcgggaaaaccgcttatactataagacagaaagatcaaatgaggtggagtcagtatgtccatgacgaaggatatcggtatcgatctgggtaccgcgtcggttttggtatatgtaaaggggaagggaatcgtcctgaacgagccgtccgtggtggccatggacaagacaaccggcaagctgctgaaggtgggcgcagaggctcaggccatgctgggccggacccccggcaacatcatcgccatccgccccctgcgggagggcgtcatctccgactacgacatgacggagcggatgctgcgggagtttatccacaaggtggcgggcgtgtccttcttcaagccccgggtcatcatctgcgtgccctccggcattacggaggtcgaggagcgcgccgtcatcgacgcgggcatccaagctggcgcccggaaggtctacctcattgaagaaccggtggccgcagccatcggcgctggcatcgacatcacccagcccgacggtcacatggtggtggacatcggcggcggcaccgcggacatcgctgtcatctccctgtccggcgtggtggagagcgcctccatcaagatcgccggcgaccagctgaacgaggccgtggtcaagtacatgcgccgcaagcacaacctgctggtgggcgagcgcaccgctgaggagatgaagaagcagatcggctgtgtcttccccaaggacgaggaggagaccatggacgtgaagggccgctgcctgctgaccggcctgcccaaggtggtcaccgtcagctccacggagatgatggatgcctttgaggagccggtggagcggatcatggaggccatccactccgtactggagcggacgccgccggagctggtggcggacatctccaccaacggcatcgtcatgacgggcggcggcagcctggtctccggctttgataagctggtgacggcccggaccggcattcacacagtgattgccgacgacgctatcagctgtgtggcgctgggcaccggcaagagtctggactccctgaacgccatgcaggacggcacgatgaatctcagccgccgcaagcagatgaactgatgtgtgacgcagcggccgcgggctggcacccgcggccgttttctccgctgacagcccggagagctgttgcgaaaacgactgcacccctgcggagcggggcatatactttgcgggaagagtaggaaacggcacaggcatatcccgtgctttacgatcaaggacaaggaatgaaagtatgctagagttcaaaccagtgacaaagcaggaggccccccgcctccggcggtattaccagacctgtgagttcggcctgtgtgagtattccgtgggcaccaagctcatgtggaaggccgcgctccacccggcctgggcggagattgccggatgcctggtggtccgcaatgagatcgacggccaggtagtcttcgactacccggttcccggcccggagggggacgaggatgcggccctggaggccattgagaacgactgtctggagcggggtatccccccggtgatctctgtggtgccggagtgcagggccgccaagctgctgggccggtatccctatgtgcgggtcagcgatgtgcggacctggcgggactacgtctattaccgggaggatttgcagttcttcgccgggcggcggtactccggccagcggaaccacatcaacaagttccggtccaagtggccggatgcgcagttccgccccctgacggcggcggacgcaccggtgatcgagcagttctggcaggactatgaggcggagttccccaaggacagcaacgccaaggccaaaaatgagctggagctggccaaaaagatgctgaagatgaccggcaagccctactttttcaccggcggcatgtttgacggggagaagctgatcgccctgtccctggcggaaaagtgtggggacaccctgatcatccacattgaaaaggccctctactcctataccggtgtatatcctgcgctggtccaggcattcgccgacgcctttggcgatggctgccagtggatcaaccgggaggatgacgcggcggacaagggcctcaggacttccaagctccagtacggcccggccaggctggcgcccaagtaccggttcgatccccagaatgagctgctgaaccacgtgcaggccattccggagctgaagacggagcggctgaccctctccgccctgacagaggcggatatccccgcctacaacgccctggtgctggacgccgaccggaaccgctggtggggctatgacgatgtgggcggcctgggcggccgggtggaggagcggagcttcttcgacgtggcgaaacgggattttgaaaaccggcaggcggtgaactttgccgtccggctggatgggaagctcatcggcgaggcggtgctgtaccggttcgactgccggggcggcgcggagctgggctgccggattgacaaggcatacgccggaaacggatacggcaccgaggccttcgctgctgtggcggagtggggcctgtacaaaatccatctgagccgggtggtggccaagtgttacaaggagaaccaggcgtcctacaagatgttgtcggcctgtatgcggaagaagggggaggacgacaccttcttctactttgaaaagctggtataaagcccatgccgccggtgcctcagcaccggcggcatgttttgattcagatgtgcagatccgaccggcggcagaaaccgcctgggagaaggcccagctccgcggccttggtggctgggatccggcgggagaggcgctttccggtccggtcctctgccagcacccacatctgggactcggccaggacctccccgcagcaaaagtccaccggctccagtttcaggatgcgcagcgccccttcggcgggagccgtcactgcaggtactccgggccaaagctgtggggcagcagttcttccagggtgaaggtccgctcctctccggcgccgttgagacagatgatctcgatgttgggggcaaactcccgcagcacctggcggcacacgccgcaggggacgcagagctcacggctccgcccggcgatcacgatgcggacaaagtcccggtgcccctcgctgacggctttggccaccgcggtccgctcggcgcagatggtgggaccgaaggaggcgttctcgatgttgcagccggtgaacaccgtaccgtcgctgcactccagggcggcgcccacggggaagtgggaataggggatgtaggcccggtccagcatggcgacggccgcggccttcagttcttcacgggtcatggaaatacactcctttgcaagatgcgctcaactgacggccggaagcgacacccagctcaccggcagagcattcaggtcggtgtccgtgctggtggtggccgggatatcatactggacgatcacccagccgcccagggtgggggcatcataaatgtccccgaacaggccggacaggccgccgcccggctttccccaggcgtccagaatgtcctggcggcaaaaaccggacagggcctcagcggcttcatcattcgtcatgccctcgatctcagtcagggagggaacctcctgttctgctttcccggagccgcaggccgtcagcccggccaccagaaggatggacagcagaaacaaatagacacaccttttcacggtggctctccccccttacgcccagtcgatctcccgctggggacgaaccgttacatccatgatatcctttgcgtcgtaaaattgcaagtaccggtctctggaatggcgcagggtggtgccgtccgggtggagccggtcgcagatgacggcgcagagatccttcttgatatagctgaagctctcaatgcccacggaggcaaagactcggaagccctggctctggaggtattggaacaccgggccggtgttctgccagtcgttgccgtcgggccgctccccgtgagggtaaaacaggatggtagtgggacccaccaggctgcccacctcgtcaaaccatcgctgggtgtccgcctggatggattccaggctcttggtgcccaggcggatgtgcccccaggtgtgactgccgaaggtccagccggtgcgcttgagctctgcgataataggcttcaccgcctcgatctccttctggcggttggcctcccgctccgcggtccactccacatcctgatccgtctgggtgcggtagcccaggatgccctgatatcccgtcaggctcaggcagcccttggcgccgaagggggagaagtccaggtgctcttccacaaacttgtccaggatggggatggcgtccaggtcccgggaggtcacctcattgccctgggggtccttgccccaggaggcgatcttgccatcctccccgatcaccagcttgtaggtgaagccattggcaagcatatattcatagtagttggtgtcgtcgtaggagaggatcaggggctttttgccctccggcaggtagagggtgttccgaaccatcttaggctgaccgtcctcgccggtggtctcgctccacacatcgccgatgtccaccagcacgtagcccttgtcatagacactctggaggattttgttgtactcatccaccgtcaccatgtaatcgtcaatgccgttggcctgggcgtctccgtcaaaggccagctccggataggccaccactggatggaagaacaggtgctccacgatgccgtcataggccgcgtaggtgacaccgtcccgaacgccgccctccggcatgaccgtggggtctgaaatctcatagggttccggctccggcaactccggggcctcctcttccggagtcgggtctccggcggcattttgagcggagccgccagcggaggctccctgcccgcaggcagccagggagagcagcatcagcgcggcaagcagcagtgcggtaaaacggcgcatgatcggatgttcctttctgtcgatttttgtcggtgaccatagtatagcaggaaaccggacaggaaagaacaacaaaaaaatgacaaaataagaacagggcggcaacggttgccctgagaccgcaaaaaagtggctgcagccactcttttagagctgcagacccagcgcgcaaaacctgcccgccataggagacggacaggtcttgcacagatggggcgggaagtggtttcggccgtgcgcaggaggcggctgaacccagaatttgatgcgcctgcgggcacgaatgccgcggcggccccggttcccttaccgcttgtcccccggccggaagatggccgccatgagcacgcccgccaccacggcggccgtgacgccccccgccgcagcggtgagcccgccggtgaagatgccgatccagccatcggaggccaccgcctcccggacgcccttggccagcgtgtggccgaagcctgtcagggggaccgtggccccggcgccgccccactgggccaggggctcatacagccccagggcactgagcagcacgcccactaccacgtatccggtgagaatgcgggcgggggtcagctgagtcttgtcgatgatgatctgtcccacggcgcacaggataccgccgcagagaaacgcgttgagatattccatgagatgtctccccctcttttcataagagcagtgtgcccggttccggcgggattatgcagtgcggcccggagacacagatctccgggccgtgatgaaaccatggggcgaaaagagatgtttattccgcatcctggagtgcgccgtatccctcttctccggttcggactttgatgacgttctccacgtcgtagataaagatcttgccgtcgccgatatggccggtgtacagaacttttttggcggtctctaccaccaggcgcacaggcagcctgcacaccacaatggacacttgaatgctgggcagcatagtggcctccaccctggccccccggaagtagccctcggtcttgccccgctgttcgccgcagcccatgacgttgatggcagtcatgccggtgatgccgatgtcgaacatggcccgcttcagggcatcgaaccgctccatcttgcagagaatgtctaccttggtcatcttgacgccgggggaagcggataccgcatctgccggggcagtgaccacctccaccggcaccgcctcctgcaccgggaccggcgcggcggccggggcggcaggattcagtacagcagcgccgtctggggtatcgtcataggcaaaggcaaagccgccataggcggtgggcaggccgtgctcggtgatgtccagtcccttgacctcctcctcgggtgaaacccgcagaccgatggtatgcttgagcacctggaacacaatggtaatggtgacaatggtccagaccgccgtggccgctacacccaggcactgaacgccgaagaaatggaagccgccgccgtagaacacaccgccgtccactgccagcagtccggtgagcaaggtacctgcggccccacagacgccatggacagagatggcgcccaccgggtcgtcaatcttcagcacagagtcaaagaagttcacggagataggcagcagcaggccggctgcgatgccgatgatggcggcgccgccgatggaaaccgcatcacatccggcggtgacggccaccagtcccgccagggcggcattcatcgtcatgcccacatctggctttttatagcggagccaggtgtacagcatggtgacgcagcaggcgacggcagcagacatattggtgttgacgaagatcagccccgcggagaccagggtgttgtctccggtcatggagacggtagaggccccattgaacccaaaccagcagaaccacaggatgaacacaccgagggcaccgagagagaggctgtggcccaggatggcccggggtttgccgtccttgtcgtatttgcccagtcgggggccgaggatggcggcgccgatacaggcacagatgccacccaccatgtggaccgccgtggagccggcaaagtcgtggaagcccagatcactgagccagccgccgccccagatccagtggccggagatgggatagatgaaggcagaaatgcagaaggaatagatacagtaggagaggaattttgttcgctccgccatggcgccggagacgatggtggcggatgtggcgcagaaaacggtttggaagatcagataggcgaacaggggcacgccctccggcaggatggcggagtagtcccctggaccatagggtccaggccgccgatcagggccccgccgctggcgaacatcaggccgaagcccagcagccagtagaccggcgtgccgatgcagaagtccatgagatttttcatgaggatgttgcctgtgttcttggcccgggtgaagccggcctcgcacatggcgaagcccgcctgcatcaaaaagaccagcgccgcgcctagcaggacccagatggtgttgactgatgaatacatcgtgttccctcctaaatcaccacgggcggcggccgcgcgtcacgccgcgccttggaacaaatacaggcaagggcgtctgtgagatggtctcacaggcgcccttgcctttgatggagaacactttaccacggtagacggacagcgtcaagacacgttcttcacaagaaatctgctgaatccgccaaaaatttatccgaaatttatataggttgaccaattactcccggacggcgctcaggcgcacggcgtggcagatggaggggatggactccccctggccagaagaggtgggggagagcagcgccccggtgggggcgaagagaatggtcttccacttgccctcccgcatcttgcgcaggagatagccgttgagcacggaggcagagcagccgcagccggaggctccggcgtgcatatcctggtgcttccggtcatacagcagcaggccgcagtcctggaactgggggcccatgtccacaccgtcccgctggaagaagtcccggacgatggcgtggcccagctctcccaggtcaccggtgaggatcaggtcgaagtccgcgggcttgtacccggtgtcccggaagaaggcggaaagggtgtcgtaggctgcgggggccatggcggcgcccatgttgttggcgtccgtaatgcccttgtccacgatccggccgcaggtgacgtgggtgacgtaggggccggggccgtcgctgcccaggatggtgcagccagccgcagtggtcgtccactgggcggtgggcgtccgctggctgccgtagggcaccggcatccggtactgccgctcggcggtgcagaagtgggaggaggtcagggcggcggcccggtcggcgtagccgccatcgatcagcagggacgccaggctcaggctctctcccatggtggagcaggcaccgtagagcccgtagaagggcacccggaagtcccgcaggccgaaggaggagccgatacactggttcaacagatctccggccaggatatagtccaggtcctccggcgtcagctccgccttctccagcgctcgctgaaggaccgtcttctgcatggcggactctgctttctcccaggtcttttccccgaagaaggagtcgttgctgatctcgtcaaaaaagtccgccagggggccctggccctcgaatttccccccaatattggaaaaggagaggacggaggggggatgggccagggccacggtctggcggcccagacgcttgtcattcatgatgcgccacctcgcaattgaagaaagttttcgtagctagattgtcccaaagaggcaaaaatatgaggcccggcggaagccggacctctgaaaggtcattcctgttcatatcgaaacggcaggccacaggcgtagcaggaatgccgattgcccttctggcggcggccgcagcggggacaggcgatgacctcatctgtccgggcgggaaagacggcgggggcggcaggcgggctttcaactcgggtgccagcaggtgtgccagatccgctctccaaaacagccaggcgcgcctttaatgtggcgatctcctgatcctgggcgcggtcacgtcctacggcgtccgcacggatacgggcgatgtccggcagcaggagcactgccagcagaccgatcagctgccccaacaggcacaacaggaagctgaaccagaaggagtagcccttttcccggccataacggccacagaagaagctgatgactgcccaggccatgacgatcaggagggagagatcgaggcgtcgttcgcatcaaggttcagcgcagcaaacatagcggcacctcctgtacttattcatgttcatattgaaacggcaggccacaggcgtagcaggaatcccgattgcccttctggtggcggccacaccgggggcaggcgatgacctcctccgtccgggcgggaaagacggcaggggcgtccggcggacgcttggggggcgctgcttgagcatccgctgccggggcggcaggctccggggcgggcgttggttccaaagcctgctccagttcggccatccgttggcgtagagaggacagctcctgcttcagatggtcggactcgtactgctcctgcatccgatctggtagaagaatcagaataagcaagcaaatgagcctgccaaaaaagcccagcaggatacacaatgcagtggaataccctttttggcggcccacaatggcacacatagcggcaaacagcaggccgatcaaaaaggagatgagcattgcagaggacacggacagcagatgatacatacagctccctccttttgccccatcatagcacagaaaaaacgacttgaacagacctgttttcagagaaaacgggcagttagcctctgctaatgttcaaaaaactctgtacaactgttccgcgtggtggtataatcttcatctaatggaaacatcccggtcaggaggcgcataccatgaaagaagagatgcggacatttggatacctctgcccccagtgcggcaaaaccgtcatggggacccgatctgtctttgcgctggaggcatccaacgccgaggtggagtgcgcctgcggcaagtctgccctgaaggtggagttcgacgggacagagtaccacatctacgtcccctgcggcatctgcggggagacccatgaggcccactgcccgccggagcgggtgctccggggcgccaccgccctgggctgcgccaagacgcggcaattctgctgctttatcggcccggaggggacggtggagaaaaacctgcgggatctggcggtgctggcggagaaggagcaccagcagcaggaggacggcgaagaggcatttgtggacaacgtcatcatgtacgagatcctgtctgagctgaaggatatcgccgcccggccggatggaatcacctgcgcctgcggcagcggacggtacggtatggagatccgccgcagcgccgtggatctcatctgccgggactgcggggccaagcttcggatcccggccgccacggaccgggacttggacgatctctgctgccacatgaagctggtgatccccggaaagcggaactgatccgctccaccggtccggccatgggacggaaaagcgcaccctggcccaaaaccacgccgccgcagggcggctttttcctggccggagatgcccggctggatatagacaccggggccgcggccccatggaaaggaaggaacctgctttgatctcactgctggcgcggctgtttatcaaaccggacccggcccgggaagagccggagacccgcagggcctacggcgtcctctgcgggattgtgggcatctgcctgaacgtgctgctgttcgccggaaagtttctggcgggcaccctctccgggtccatcgccatcacggcggacgccttcaacaacctgtcggacgccgggtcctccttcgtgacactggtggggtttcagctggcggggcagaagccggactccgaacaccccttcggccacgggaggatggagtacgtctccggcctggcggtatcggtcctgatcctgctgatgggcctggagctggggaagacgtccattgagaagatcctgcatccggaaccggtggactccagcccgctgatctttgcgatcctctgcgcgtccattctggtgaagctgtatatgttcctctacaaccggcggctggggaagaagctggcctctcccgccatggaggccaccgccatggactccctcagcgacagtgtggccaccgccgcggtgctgatcgccacgctggtgggccgtttcacgggcctggagatcgacggctggtgcggcgtgctggtggcggcctttattctctggtccggcatcaatgcggtgcgggacacgctggaccccctgctgggcacgccgcccacccatgagttcgtccagcgcatccgggatctggtgatggcccacagcaccattctaggcatccacgatctgatcgtccacgactacggccccggccgggtgatgatctccctccacgcggaggtgcccgccaacgaggacgtgctggccctccacgatgagatcgacaacgtggagaaggagctgcgggagaagctgggttgcgacgcagtgatccacatggacccggtggtgacggacgacggcgtcaccgaggagacccggcggcgggtccagaccctgatccactgcatcgacgacgccatcgacatccacgatttccgcatggtagcgggacccacccatacgaacctgatcttcgacgcggtggtgcccttcggcttccgcctcacggaccaggaggtggagcagaaaatccgcagcgccgtgcgggcgctggacggcaattactacgccgtggtgaacgtggagcggtcctatacgtaagagaaagcagagcggcgggcgcatagcgcccgccgctctgctgcgccgatcaggctggattcgtgccgaattccatattggcgtaaatgcgctccatgcggctgtctgggaaatgctcgtcaaaaaacacatccacggcggagacgggggtctctccgcggacccgctcggaccagcggtccactgccagcaggctcatggcgcagtcgaagaccatgaaaatggtgaggacccaggtgaggaccttgccgaaccggttggggatcttcaaaatcacctgagcgacccggggatagaggcttttgatccacaggacgcccagaatgccccagaacaaagagtagagcaggcagatccggccgtcgaggttgaagggcatccgactgtaatcccaggaagtggagccgaagagagtctcctgcccccaggagagcaggtactcaatgacactgcccaccacagctccgccgaaaaaggagatggaggagctgcggttgcgatagcggtacagggccagggtcatcaccactgcgccgataccgtagacagggttgaagggaccgtaaaccaggccggagcggctttcgatatacccgttgcggaagaggcaccacaggatctccaccaccacgcccgcaaagctgccggcgatgcagatcaaagcgaccttgtaaaagttgacgccggaggcaaagctatctgcctgctcctcctccaggtcgataacggagttggcgggggcacggcggaagaggcccttgcgctgggagctctcctgcccctcccgcaggcgggtggtgagctcgtcggccttgtcggaggcccactgatgggcctgacgcaggcaggaggaggcatcctccagcatctccacctcccgggtcacgtcgcttcgcagggcggcttgctcctccggagagaggctttgctggtcggccagctgttcgtaatactcctcatactgaacttccagcgccttttccgcacgcaggacgtcctgactgcaatccaatagatcctttgtctgcataaaaacctcctgtcgaaatttgccgttgtgggatatagtagcacacggagggcgtgaaggcaagtgccgctccgttgtgcaggggctgcaggagtacaagaaaaaatcccgccacattgctgtggcgggatttttgaaagtgcaatcgaagaatcagcgcttggagaactggggagcccgacgggcggccttgaggccgtattgcgcgagtttttgagctgtttttccttgatattccgggcttttccggctttctgcttctcagttatccggtgtgcggaccataaaaaacggccttttttcattcagcgatagcctgatgaaacgcaccatttactaccccaaacaactcctctggtttattatacttcacttttgcatagatgtccatagttgttttgctgttttcgtgtccggcaaggtattgtactgtctttggatcaacgcccgcatagagaagattggtgatgtaagtgtgccgcagctgatgaggtgtcacatcaaagtccagcgtatatttgatttggggttgattcttctgggtcatacccagcgttggagtaaccgtatatttgatactctccccatttacatacttataatagttccggggcttagtggagcggacaacgacatactgccacactctttggaactgcgaggcagccagtggctctcctttgctgtcagcgatcacataatctgatatggaattttctttcgtttctctcagacagtccaccaaacacttcggtatcggaatatccctttttgctgccggagtctttagcaccgtagaaaccacgggtctgttatgctctgtacgccatgcccgcctcaccgatagataaggtgtatcctcgtccagaaacacacaatcccattgcagtgcaagaatttcttcccgacgcagaccggaatacaaaccgagcataataaacaaatatggaggaagccccttgactgtatccagaagcacggctacctgctgatctgtcaatgcctccttcttttttgtcggttttccgcctttaccggatattcccgcacagggattgtgttcaagaatttggtttctctctgccgcataaaaaatgcacttgagcagcatattgaccttattgtataagccttccgatttctttgacaatggaacaagagccagccgaatatcgtcagcagtcacttcttccatatacatctctcccagaggtttgatgatatagtttgtcatatccctcgtataacctctgagtgtagacgcagacacctttgccgactgcatcagcagccacttctctccatactcagctactgtcgggtgctgccggtgaaagataatttcttccaccttcttccgggcctctaactgcttctcatacaattcttcacaagtagcggcatacaaactcaactctttgccatctgcatccgtaatcctggttctgtaatactgaattcctttcaatgtaatggtcccatacttcgggatctgtgttttcttttttgccatctttgatcgtcctttcttgataatgtgtagtctccgtatctacactctctttttatcagaaagcctcgatttaatcaaagatacggctgatgtaaaacaaagagcgagacatccttgcctcgctcctgctttacttcctattttattattactgtgctgcgtcccagcttgcaaacgcgcaactcattgatctgaccagctcatctggtctgttgtacttaacctttgcataaatgtccatggtaatcttgctgctttcatggcctgccaggtattgaaccgttttgggatctaccgatgcatgaatgagattggtaatgtaagtatgccgcagctgatggggtgttacttcaaagtccagactgtaaaccacttttccgttatgagcagccttttcccccaagacaggtgtgacagtatgctttactctttttccatcttcataccgataatagctccgctccttgaccgtcctcgtaacaatatactgccaaagtcgcttaaactgcgtgtaggacagcggttcgccgtcccggtttgaaaccacatactccgaagtcgatgtttcctttgctgctttcaaacactcagccaagcaaacaggaagagggatatttctctccgcagccttggttttcaattcgtctgagattaccggtctgttgtgttctgtgtgccatgcccgccttaccgtcagatatggagtatccgtatccagatatactgaatcccattgcagagcaagaatttcttcccggcgcagccctgcatataaaccaatcatgacaaagacataaggcggcaaatctcggatagcatccaaaaggcgtgctgcctgttcatctgtcaaagcctgacgatcctcttgtggaacaccgccaccttttgtcgtgagataaatcgtcgggttatggtcaatgatcctgctttccatcgctgcgcgaaagatagatttgtaaaggattaccacagatttataaaccgatgcagatttcttggaaaccggaacaagggcaagctgaatatcatccaggctaacctcacccatccgtttatctcccaattccgctataatatgccgcctgacctttgaggtgtaatccgtcaaagtagtagctcgtacatgaaccgactgcatcagcagccacttttcacaatactctgcaactgtgggcgttttccgatgaaaagtggcattctcaatctgttccaacgcaagcgtttctttgttgtatagttcttcaggtgtttttgcgtagatagctacgagcttaccattcgtgtctttgattctggtcctataatataggacacctcttttcataactgtgccatattgaggaagcattattttcctatttgccaattcctccacctcctaagaatatactccagcgctgtatctatgttttatcagaccattatgatttcgacaaggatacggaccggctcacactccagctctgcgaggtttacgatatgttgcgttcttttctgctggctttgctctgtgggtgcattttgcgatatactcctgaaggcccgccgaggtaaagtacacacagccattctgcacatattgcacataagaaataaggccattgttacgggccgcgtccagcgttgcaatgctgatacccaaaatttctgctgcttcttttcgcgtaataagtttttccataaagcatatttcctccaatccgtcaagtttgtcatcgtgtttgttcaaaatcacatgaatacgctggcagccgaaaccaccagcgcatggtatctgattttgaacagaaagcggcaaacgcttcctatttatatttctcagctttcgtcacatttgccacgccccctgacgatgggaacacaataggtctccgctggcgcggatgtcataactccgcagcatcgttcgtaacgtgtgccgcagggttccccccaagtctttggcgggccgtgaggaagtatctttaagcccccatgtagtcatcgcgccaaatctgccaccattcttttatgaaatcgtagatcgctccgaagcagtgctttcatcacctccctgactgctccatcctcgcggcgtttcatattcgctcatacatgggtttatgtacctgttgtgctgtctattcgattgtcaatgtgcagatgaaggaggaaaacttgtccttcttattaacactgacaaaaaaggcaaaaaacaggcgcatcaaatgaaactttatcaaaaatattttccgagctgctttaagccacggcggatactgtctcgaacacggcttgggtctacaccttctacttcggcaatttcatttaccgtcattcccagatagtatcgggcataaattcgctttgcctgtttctccggcagcttcatcacagcggcatagacctgctcctgaaactgtttttcctccagaagcatctccggtgtctggggcttcatcagaatcgcattttcaatgccgttgtcgcagtccagggagtagtacgccttatagcgatacatcctccggtcataagcagcttccgcacgttcagctgctcgaatagtctccattacttcctctgtcacatctacaaaaaagtctgttggataaacatcaggataaagttcccgaaggttaattttcttcattatgtacctccatttcgattcacgggtgattgacgggtgaatcgaatggaggcggggaccgacaccggcagacaaccggatcatctccgaaaaaaaggcaacaaaaaacgccagatttccgcaatgggaaactggcgcaccaagaacagtcattattatgctgaatcacatggaacgataatgccgatgcaatgctatacttgcccggaggaggggcaatgctttttttaattgatgtagatcatgggagctttgaaaaagcaaaagagacacggcaaattaacctccaagcggctaccgtgtccctgcaagtcgtcattagtttgtgtaaacgcaaagaaacggcggctctgaaattgtccttcaaaaccgccgattgagttcaaaccttaaaatagcgcacgaaattatctgccccagtcaacggtttttttctttccccggacggggcagataacttattatgcagagcggagccgatgtgcgctaatcggttccttgtactttctccttcagctttcggaaagatgtatcactgatggcgtgttcaatccggcaggcgtcttgttccgctgtttcctgatcgacgccagcagcgataaactgctccataaaaaacaaatggcgttcatagattttctcggcaatctcccgacctatgacggtcagatgaaggaacccatcatcatccacggtcagaaaacctccatttttcaaaacgcctaccgcatggctgatactcggtttgctaaagcccatgtgccgggcaaggtcaatggagcggaccatgcccattttcttttgtagaacaaggatagcctccagataatcctccccagacgcatgaatcttcatcagttcctcctttatgcttattgttgaatcctccacccctcagcctgttcccgaatcttaataaattcctgataggttcccctttgagccagcaattccttatgggttcctttctgcacgacggttccaccatcaatgacaagaatttgatccgcattttcaatcgtcgccagtctatgggcaatcgttatgattgttttaccatgtgtcagtgcggaaatagcctcttgaatcaaatgctcattctctgggtcaatgctggccgtggcctcatccaaaataacaatcggcgcatctttcagcatggctctggcaatcgaaatccgctgcttttcaccgccggaaagagaagaaccgccctccccaatgacggtatcatatccatctggcaaggccataataaagtcatggcagcgcgcttcttttgcagcggcaatcatctgttcctccgaagcgtccgggctgccgaatttgatattgttacggattgtatcccggaacagatatacattctggaacaccatactgatattttttagtaagctgtcacaggtaaattctcgaatatctgtttctcctaaagtgatttttccggcgtcaacatcataaaagcgtgcaatcaggctgcacagggtagacttgccgctcccggagggacctacaatcgctgttgtggtattctgcggaatcgtgaaattcacatcgtgcaatacagtccgtttatcgtaaccaaaggatacatcctgaaaagtaatgtcatacgaggtcggtgtaatatcttttccgtcttggtcgatatattctgcattttccagagcttccagcttattcatagcggaatctataagacccagcatgtgagccgcgtcgttaatgttttccacacttccaaagattacgaaagaaaacagaacaaacatcaggaaataagcaagactcatttgcccgttaagtgtctgccatgcacagataaacacaatccccatagatgccagttttaaggagaacagatgcaagcagttaaatggcgtatagcctttttctactttgatatgaatatttttcaaatccgtatttgccttgcggaaactttcgatagaagccccttcctgtccgaacgatttaacgatggacagcccgcggatatattcaatcgcagagccagacatatcctccatggcctggtgcgtgatagcagcggtcttttcactatgcctgctgataccatgtaaggccaatgaggaaaaggcaacgccgacaacagaaatcactgctgcggctggactcaggaaaaggaaacacaggagaattgcaataaactttgcatgtccgttgatgatgatgtcaaccatcttcattccctgcaattcaagtgtggatagctccgtggtaacacctgtcagaatatcgcccacgctgtttttagaaaaatatcccagaggaacccttttcagcacatcgcctaaatggattcgctgccctgcggctacttcataaccaatgctttcctgcaacaccgcccgcaaataagagagtagaaagttaagcgcaatcgagccaacaataatccaaagcgtctgccagatcagggaggattctattgtgttgcctgcccaataagctgcgattgctttatcaagggcataagcggcagccattgtagggatcgccgtagacaggctgctgaaaaaggaaaaaacagagccaagatagaggcgtcccttatatttctccgcccatttaatgatccgtttcatagacttaaacatgagcggccacctccttcttttcactcacagaccaattcttcgccccgatgtgggctttccacatatccgcataaagcggacaccgcttcaacaattctttctgctttccgcaatccacaatccggccttttttcaacacgacaatctgatctgcgttctgaatggtggaaaggcggtgggcgatcacaagaagagttttaccctttgataacgccatgatagatttctgaattttatcttcgttctgcgggtcagtaaatgctgtcgcttcatccaaaataacaatcggggcatttttgaggatcgccctcgcaatcgcaattcgctgtttttcgccgccggacagcctctttccggcatcaccggcaggggtatcatatcctttgtccaaacgcacaataaattcatcacagcaggccgctttcgccgccgcatatacttcttcatctgtggcgtttggatttccaagacggatgttttctttcagggagcaattaaacaggaagttatcctgcgtcacaaaactgaccagttcggaaagctggcgtatagacaactctttgatattcttccccccaatggtaatgttgccgcctgtcacgtcccaaaaccttgcaatcagacgggcaatcgttgatttaccgccgccagacggtcctacaagtgccgtaaaacttccctctggcaattccaggttcacatcatgcaacacttcattttgctcggaaccgtcataggaaaaggttacatgcttcaacgcaatatcattgtgaggaatagatacgattttccctgaatccggcagtacaggcaggttcaaaagttcatttgccgcctctactgcatattccatagactttgcttcgttaatgaaagtggttgctttcatcaacggtccaacaatgctgagggaaaggataatccccattgcaagctccgcaggggagatacttccattctgcaccagcaaaaggccgacaggaagaacccccaggagcgttgtgggcataatcgccatcataaggttcatcgatttccatgtactcttaaaccatgccaaggtaaactctttgaacgactggacagcattaacaaatttttcataggagcttgtgctttggttaaaggcctttacaacctcgataccttccacatactcgataataatactgttgacgtggttatttgcctccatataagcggcgtactggctgttatagttcctcataaggaaaaacataggaatcatggccagcaccggagcaatcagaaccgccaatcccatgcgccagtcgataaccagcatccagataaaaattgcaacagggagtaggaggttagaggtcaattccgggatcatgtgtgccaaaggcggctctaagtcctcaaccttatccatgatgatatttttcagatagccgatccgccgccccatcacttcgccaaggggagctttcatcagccggtctgcaattttaagccggattccttccaaaatggtataggctgaaatatgcgccaggatcgtagagattccatggcaggcaacccgcagcaggtagcccgctgctccaaccagacaccaaatcagaatgccattcagggtcacattctgattgataaatgccagcaggatttcatatacagcccaaaaaggaataaaccctcctgcaacgctcagaatggcgcagaataccgaaagagccattttccccttgcatggtgcagcgaaggaaaacagaattttcacccaattatctttttgctgcttcattacaatcaccttccttctttttagtcagcaaagaaaaaaggatgggtagtctttgctaaccatcctcattgtagcagtattcaattcttctttcctctccaaaacggcatttatgcaccgtttagaaaaaagattttcggtattccatcggcgtctgccctatcacctgccggaaagctgttgcaaatttactggggctttcatatcccacagctccggcaatttccgcaatccctttttgggaatcctgccggagcattgtggcagcaacgttcatccgataacggcgaagataggaatacatggaatctccgaatatttccttaaagcaggttttcatccccgtcaatgaaatctggaatcgttcagctaattcatccatcgtgtaatgctcctgcaaatttgccgtaataagatcatggatcgctttgattttttctacctgccctttatagaaataagggcgatcttctttggaatcagaaaactgcaaagcgtccagatataaaagcagctccatggcttttactttatagtagtcacctttgatctgctgcgggacaaagtaaagctctgaaaaaatatgttcaattcctggctcattatgaatcacaaacggtttcttgtcattgcaatactttttttgaagctcgtacaaatcaacagaaaatccgccaaaaaagtctttcagcgccggcacagcaatgtccagatcaaatcccagggtcatcccatgatagtggcagagtggaaagcagaaccgtcccgaatgggaacgccggtcatccacacgcatctcatgctcttgcaaatagctatacgcattattgccaatctcgctttcgatccgtccctccctgcaatggtctatatagagaagcgaactgtccgtactactctgaaagtaggaggtacattctttcaggtgcatatcgctatacatcacaaaagcgccatcaaaaattttgtgggctgtcatggttccctcgccgctctcgtcaaaaagctgcaggacaacgcaatcctcagtttcaatgacatttttaacatttgagccgcagtttattttaccatcaaacagtttgatttccgccgcctccttccatcataaagaaattaaataaccgttcccgtccttccgtattctggaggaaatagctttcctccaatctgccgttttccagatggatcacataattgcagcacctgagtataaattcaggatcatgggtcacaatcacaatggtttttcctgaatcggcaagttctttgactgaatcggctacctgcctcatgtgaaaaagatcaaggccgctggtaggttcgtcaaatagtataaccggacgttcagaggcaatcgcagaagcaatcgccacacgttgtttttgccctcccgaaagccccatgggatggcaggctttgtacggaagcaaatccatttctgtcaagatagcctctgcctttgccacattttcaggcgattcatccgaatcttttcccggcatacttaacaggacttcctctaaaacgctctctgtaaaaagctgatggtttacatcctgcatgaccatatagcatagcttcagtcgctgtttgcttgaataggaagtaccatctttttggaggatacctttacatcttttttccaatccgcataagcaacgggatagtgtcgtttttccggctccattgtgcccgatgaccgccgttacatttccggcaggaagctctatattttccagagaaagcgtttccggctgtttcttgtatgcgaaatggaagtggttcagtttccatttcccctgccctgaatgtagactggcaggctcaatgtctgcaaactcacccaggccaagaggccgtaatcccattttagctttttccgccgccggaatcaactgaaattccggcaaagtataatccccttgtatttccccgtcgcttaaatatatgatcctgtctgccagatcataaagatagtagagccggtgctccgcaataataattgttttgccctgtgacttcaatatttttaacagtttccgaaaatcagcgatggaataggcgtcaaggttggaagatggctcgtccaaaacaaatacatccggttccacagcggcggcagatccacaggcgattttttgcttttccccaccggaaagggagaaaacacttctgtccagcagatttgtaaggttcaactgctctgagaccagctttacccgctttcggatttctgcttcttccaatccatggttttcacatccaaaggcaatttcgctggtcgtatccacattaaaaaattgagaacgtggattctgaaaaacagaacccactttttttgatatatcaaacagggaaagcccgctcatatcttctccatcaagcatgacagtgccttccagctttccatcgtaataatgaggaatcagtccgttaaacagccgtgtcagtgtggttttaccgcagcccgatgttccgcagagcagtacaaaatccccgtcgttaatagacaggtcaatatttcttaatgttccgtgtcctttcctgtccccaatgtcagtttcatttggagggtaggaaaaagaaacttttttacattcgatcataggcctacctccctgtaatcatcgtgacaataggaattgcaaaagccaccacacatagcagcaggaaaaaaacatcctgcacatgaaagccgatttcgcagatgtttgtcctcttgaccggaccgcccaatcctcttgtcagggctgctgcatttaattcttccccgatcttgacggaacacatgataacagggacaagcctgtattccagcattgcactggctttgcccccgccaaaacggattcctctcattttcatagcgtcccctatggcattatattcttctacaacagtagggaaaaatcggaatatcacggacataggaatgatgatctgctccggtaaatgcagcttcttcatggaggcaacaaactcgctgaccgtcgttgtcctgaccgtgatgtatcccatcataatccccggcacaaaccgcataaagaaaccgcagattgcaacaacaagaaagttaggaaggccggacaggtgggggagcgcccatagttgcaatatatagctgccgccatataaaacaaaatagataaccgatcccttccacgatttttccgtgagcagcaggatcaatggaacagcagccaaaataggagcaaactgtttagaaacagccccacctccgccgctcaagacaaagagggcaatcgtgacaagcaatgccaactttgtccgagggtctaacgacaggccggtttccttttttttgcttgctaacaattcacggcgcattatgcaatacccgcacgcttaaagtgctttttgaaaattttctggccgatcacaccgccgatcacgccgcaaacgaacccggcaatcaaaagaagggggagcgtatatgccgagatatagctcataatggaatctgcatactcttgtccataaccgctgattagctgctgatagtagctgtcccgtgttgcaacaatggggatgtagtttccgatgatccacatagaaaaaacaccatgcgatatgattcctttttttgcactcttataatcgccggatttcaaaacaagatcagccaggacaccgaacacggcaccggtaataatgctccaataccccatgccggtcagcaacattaaaataccgcagatcagtcctgtcagcgataccattccaaacttctggactttagaataatacagcatcattacgattccgccaatcagcggaaccagcacgatcagaagcggaagaaaaatagggataaatcccagcatggcaatcgccatcatcaccacaaaatagatcgcagtgaagattccaacattgataaggtcttttccttgtagtttattcattatttggtcctcctgtttgcttttgtgttagcacgaactaaccgcatttcagtatagcagatatgtcagtatgtttcttctccaaaaaggcattttcgctccaaatagacaattactttgcttttgctatctttacggggagtgattgcctgcgtgtgtgcgtgagcatagaactattcaacattgaacagaggcggttcttgcataatttgaaatggaaacagccaaaatcaccgcttcaaattgtagtattagtagagggagaaatagaaggtagggtttcgatagcaagcacagcaagcgagtacccgcttgcgatttttcggattttcaggtcccttgcccgaaaatgaaaaatgtttgttgggataatctcaaactcttatgaagaatggaggcagcgcatggcgaaccgaaaacggaatatccagatgaatttttatgtcacagagaataaaaaacggctcatagatgagcggataaaactgatagcctccctaccgcattctatatcattctcgtttggcaacgaactaaaagctgaaatctgcaattcatcctcatagttcaattagtagccggaaacgccataatcatggagcaaccatgttatcaaaaaggaatcggcataatcagtcctgttctcaagcacaataaggttattcctttgtgcaaatcggaacgataaaatatatttgaggtgaacgattatgccgattgatgatttaactgctttagggcaaaaaatgcgggaagccagaaagaataaagaactgacacaacaggaactttccgatctaagccatgtttctgtaaagcaaattgccaatatcgaaaaagggaaaatgaacccgtcctatttgattttgagagcattggcaaaagtcctgcacatctctttagatacgcttataaatccagatatttctctggaggatgagggtgtcaatcagatgaaaatgctttattccagctgtccgccagaaatgcgtgacaccctgttgcatcacacccaggaaacgatgaaagagctaacagagttgtccgagaaatttgaaatgaattgagccagtgagtgaagtttaacgattttctcactggttctttttatttccagagaaaagaggcaagcaatgccggtgttaatacacaccgacctgcagagaagaaaatccctttgtgattttcctctccgcttgcttgttgagggcagcacccccaagcccctttgaacacagaatttcattctgtggctgcgcgttctgcgaacgcttttgaccaggaccagcttaccgctggccgtggtctttttctttttcaacatcctgttctacctccattttcaggacccgatccacattggcctttgccgttaaaagctcccgcatttcttcacgggaacgccggtactcggcataggtctttttcttttcttccagcaatttcgcatactctgtctgcaactctttgacctttggcagcttcttgacgcccatctcatcaaaggcattcttagcagcttggtggagcagaatttcttcctcatgttcttccctgaatttcttagagtaacccgccttgcggtatgccacatagacctcacgggttttggcataatttacgatgtgagtacgcagaacagcgatctctgccatgcgcttttcagccgctttgatctgcgccgaaagttcattgtgatgtgccgtggcagccgcagccttttcttccaaaaccgcatactccagcaggttatgctctgacaggtaattcatggtctgcgccatctgtttgaggttgaacaccttagcccatcgagcatagccagcgccttttccagcctgcaattttgcctgaatgtccaccagcagattgaccttcggcggcactgcctgtgtgaccgttttctttcgtggggtatgcgttttcttcccagaaagaactgcctgtaaatcttccaatccatatccttcgcccaggctgtccatacgggctgctttctcccaaccggggagcttcagacgatacgattttccacgctttgatacctcacagccggactcttgcagcagcttcagcagctcctcaaaattagcaggactttgtgataatgcgttgtcaatcgccacacgcagcagctctcgatgagagggctttgcctgatctcccagccacttgttatagctttttccgtgaggtttcggattctctacaatggacagtccgttttcaatgcagattgtatcacttaaccggcgaaccgccttggtgctgccccaaaagtttcggaatttccggtcatattctaagctgaccgatgaccagataatgtgattatgaatgtgcgacttgtctatgtgagtgcagaccacaaaggcatgtttgcctttagtaaaacgctttgcaaattctacgcccagccggtttgcttcttccggggtaatctcaccagggcggaaggactggcgcacatgataggctatcacatcatctgcgccgcgcacccgtccggtagcggcaatgtactgccgctttgccagaaggaattctgcatccgcagtccggctgtcgcacgcataactggtaataagtttgccgttatctgttttctgtggatttgctacatagtcgatgatgtcactgatcgcccgactctctgtgcggcctttgccgacatgaagcggcatgattcttgtagttgccataaaaagccctcctcgtataataagtttcaaagttaatagtttcaggtatcagcaggctttgaggtgcccgtgatacaatagctgtaggacagcagggtcaagttctgagtcctccggttgagccgtaaggctacttcactgaaagtctgttcccctgaaccggaagttagctgcaaactcattggctgtttgcctgggacaagaccgccctttcagcagtgagggctatcgcattggtctgcccaggaatgattctgataagcgagggtgccagatgctccggttatcatgggtatctcaaagcctgctggcctgaaatctccatgcggggaggtgaaaattgtgaatccactattcgttggcattgatgtgagcagcaagaacaatgtggcctacctgatgaaaccggacggcagcaaacactccagcttctccgtgcagaataaccttggcggtgctaaactgttatcagagagaatcgtatcggcacttggctccatgcagcttgagcgtgtggtgattggcctggaggccacctccatctacggggacagcctagtctatgctcttcgtgaggatggccgcttggggcggtttcagaggaaaatccatgttctaaatccaaagcaggtgcggaaattcaaggaagcctattctgacctgccaaagaacgactgggtggacgcctttgtgattgccgaccatctccgtttcggcagaatcaacagggaggtctacatggacgattaccgctacaaagccctgcaaacccttaccagagccagatttgatgtcatccaaaacttgacccgggagaagcagcggttcgccaactacttattcctcaaatgctccggcatggcccaggacaaagacattcagaacaccagcgccaccaccatcgcactcatggaacactttgaaaccgtggatgacttggcgaatgccgacctggaggaactgactgcctttattactgaaacaggccgtggcaaatttgctgacccggatgctaccgccaaggcagttcgggctgcagccaaaggctcctatcggctgcccaaaacagtaaacgacactgtaaaccaagcaatggctgtttctattgcctccatgcgcgccttgaaagggcaggtcaaagtattagataaggccattgaacagcagtttgaaatcattccgaacactttgacctccatccccggtattggcaaggtctactccgccggtatcattgctgagattggtgatatccaccgttttgattcccaagcctcggttgccaaatacgccggccttgtctggaacaggagccagtctggcgacttcgaggccgaacactccagaatgattaaatccggcaaccgctatctccgctactacctgctggaagccgccaactccgtgagaagatgcgactccgagttccggcgttactatgacctcaaattcaaagaggtcaacaagtaccagcataaacgcgcactcgctttaactgccagaaaactggtccggttggtctttcggctgctaaaggacaaccgcctgtatatcccgccggagggctgagagcgcagcttgccactctgactcataggccctgtttcaaaatttctcagggacagggctttggttggtgttgcctttttgctgtctacacagtgctttttactctgtttcgcttaaaattttcttgcatcacctacttgacttcataccattggactttcaaaatattttctctgaactctttgtgcctatcgttgaaataaactctccttatgggtataatataaagaaactaccaatacctcaaaggagggattttatgatagaacagctcattgctgaagcaaccgaatgtgatttcaaagttgctctcgaaacaaaaaagccaaaaagctggttaaaaagtgtcagtgccttttccaatgggatcggcggcactctgtttttcggagtctctgatgaccgggagcctatcggcttgtcagatgttcaaaaggatgctgaagcgatcagccgcttaatcaaagaacgaatcacaccattacctcagttcatcttaaaaccattacaggaagatggtaaaaatctattagctctggaggtttctcccggccgcagcaccccatattattacaaggcagacggcgtgatggaagcatatatccgtgttggaaatgaaagcgtaattgcccctgattacattgtgaatgaactgatcttaaagggaaccaatcagtcctttgataccctaacaacagacgcggtaaaaaaggattacagctttacacttctggaagcaacctatctggaacggaccggtctccgctttgagccatccgattatgtttccttcggtttgactgataaaaatggactcctgaccaatgccggaaaactcatgaccgatcagcacacggtttataactcccgtatgttctgtacccggtggaatggcttggaaaaaggctctatctttgatgatgcgctggacgataaagaatacgagggaaatttgatttatttactgaacagcggcagtgaatttattcgcaataattccaaagtccgttttgtcaaaaaggcacagtatcgtgtagacaagccggattatgctgaacgagctgtgacagagactcttgttaatgcgcttatccatcgtgattatattgtgcttggcagcgaaatccatattgatatgtttgatgatcgggtggaaatcacatctccgggcggtatgtttggcggcggctcaattcaggaatacgatatttacagtatccgttccatgcgacgaaaccctgtgattgctgacctgttccaccgcatgaagtacatggaacgccgtggaagtggcctacgcaaaatcgtcagtgaaactgaaaagctgcctggatacacagcggcatataagcctgaattttcctcaacagcaacagatttcagagttattttgaaaaatgtgaattaccatcttagtcagaaagacttagtcagtgaccaagattgtgaccaagttagtgatcaagataaatcacaggacatcctacacgcagtcttggatttttgtataacagaaaaaagcaaacaagaaatttgctcgtttattggttatcgaaatctcacttattttacaagaaaatatttgaatcctctactggcaagtggccagcttaaaatgactattccagataagccaaacagtcgaaaacaaaaatatattacagttcgttccgaataaacagagaagcagggcattgggtctcatctcccattgtcctgctacttttcattctaaattatattcacatcatttacccatacacccaatcctggattgcaaatttcaaactctgtaccttgcccagcagccagatcgcagccagcggcagccccatcgggctaatcaaaaaagctataaccagcaaaatcacaccattctgcggggaataggtaataagcacagccacgccaagcagagcaattaccgtgctgagcagaccaagcaccagaccggatatgtagatcagccccatgcagagccagacaaaaagcgtcaacaccaaaatgaccggtgcagttacaatcatcagcaggcatttcaaaatcttcattccagttctcccctccaacgctccagataccgtttgcacaggacatccgcttctctctcatcatcttccgtcaactcccgtctgcctttggtcagttcaatctccacataagtccggtaatcatcagctaagagattgaacagttccttgggagtatggcacacctcgccagagcaatagtgaaaatcctggtcaaattcaacccttacacatccatggcggctgatataaacttcgatggtctcgtctgcggtcaggtaatccgcaaaaatctccaacactttttcaaaggtcagcatctgttttcactcctttgcttcactttttattctactcatattatccggtacggacagtcaaaaaacaaggataccgccaaaaagaaaaagcggaggaaggtgcggcgaagaaacgccgttcctccctccgcaaatggagtatctatccctgttatgaaagtttagaaagctgagtaaggatttgactcacaccctcccatagctgttcctgccgctgggatatatcctccaagtcagcatcataaacccgcccggtctcatgcactttgcgggtcagctgatttaagttgttgctgcttcggcgcatcagggaaaccaactccttcagctccggcagatccagtttgaccacatacccatccagtgccattttccgcagataggcactcagattttctgttccgtattgctgcatcttttgatggatcaactccagttcctctgctgacacccaaaacaaaaccggcacatcccgcttgcgctttgccatggttatcgctccagctcccgttttttcggggcggcagacttatgggcgggcagctcttgtttgagcttatcccgtactgagggacgggacggttccagtttttctctctgggtacggctgcgctgctgttcttcacgcaccagatcaataaaaccatccagcacagcagggtggctgtttaaggcataaccacaacggacggtttcgggattatcattaggaatggtcttggcccattctttgttgcgtcgggagtagcgcccatcccagtcctgaagctggaccgtgttagacagaaccatagatacacgctccatgccataggtctcgatcacaccctttgccgcatcgtggctgagatacattccgtcgaagtgttcccgcaccgccgcttcaatggactccttgcattggagatttacattgttggaagctcggtactgctccagctccccatgttctctcgcataggcagcagaatgcggatagaccggtgttgttcgcagttcctctttagctctgcacacatcgtcggcacggttctcaatgctgtcccggatcacatccatatagccggtctccagcttttcaaaataacggtacacatccgccagcggcgagggagattccaaaagcgcctgggcctgtgcgtcggtcagctccagctcctccattgccatcacgatgtcctcccggatggtgtactcataggcatggtttaagacttcttccgggggctggcttttcagccagtcccggaacttgtcctgttcggcagccatcttttcataaagagctgtattcagatcgttagtattcatgttatcgcacctcctcatgctgctttggtttcttgtctgtactgcggggttgcaccgggcgttttaggttatccagcaccgaaggccgtgtgcttttggcaacaacagactcggtgtgtgcctgcccctttccgtcgatgttgagcagggtatccagctccaccagacgggcgtttttgcttctcagttcttcttcataaaggaatggctttccgacttcctcctttgcggcagcctgctgctgatagaggttatccagctgggcctttgccgcctccagacgctggggcatctgggcgagggcattgtcgatacgggtaagatttccgcgagggtctgtaccaagggttgcccggtgggtcatctgtcctttcagcaggagcgtatactcctgtttccaagcggaaaattccacggacatggcataaccccggtagttgccgatctgcaccggatcggaggttttgacctccttgcaggcatccaaaagggctgcaccggcgttctccttatcggtcagcaggtctccacgaatctccataccagcaaaaccgtcctccgggtgcgggtgagctgccaaaacctccagatcggattcaaagcccttgataaaacctttgtgcttttcaatctcctccgggaagtatttgagcagctggtcctccagacgatattgcttgctctggtggtcggctttcatcagtttcaggcgggatacctccacatccaaatccatacgctccttgatacgggggtctccagcacacaaagccttgatctcggcaaaggaaagcgccgtttcatccacatcatcgcaggagcgcaccggcgatttagaagtcatgatctgggaaatgaatttctgcttattctccaccgtctgccagaggtatgcgtcaaaggttccttcggtcacatagcggtacacatggacaagaggattctggttgccctggcgctcgatacggcccttgcgctgggcaaggtctcccggtctccacgatagcgataggtaaggtctgagcggtgcgccagcaccgctttccaccttttcccccgcttcacaccgtgcatgcgagtttccccgcacacggcgttccatcattacaaaagaatcattagaatagtaagaatttcaaagctaagaaactgtattaaatctcaggctgtcctgtcagaactcgcagggcgttcagttttgctaatgcctttttatcaagttggaaaaggttcaagtacacgacaatggtatttgggtctgtagcatgaatcagtcggtgaatatcccggtggacaattaccagattcatatacttgtctgtgccgcccctgcacaatggctgtttgtggtgacaatgtatttcatcaagccaaagctcttttccagtcacagcgcaacgcccgtattgtgcggcataaagggaaatcctgttgtccatgtactcaacacttcgtcgtggctcttttatgcgcatcagcgcaagcataatcgaagtgttgatgccaaggttcttgtgaatttccgctctaccctccggtgtgtatttacaaacctttttcttcttgaacaatggggttttggtctgaatatatccgacaggtgctacggttttactgctgataaagcgaatttgtttgctatcaccgtaattcttgcggatatagacctcattgatttgcccctttttcgtaagcctgccataaagtctgttcttcatcactgtagacactgcccggtgtatctgttcacaatccgttgcaatcatggttgcatagcggtagtagttgtgaattccgaataccatcgaattgtacagagtaatttctctggcttcgtcatctcggtcttgaacatgggcaatctgcttgacctgctcaataagagcggctgtttcttttgaaatggctttttcagtcatatgcgatttaaccacataccgtttccgcttcttgactgctttcatttcaaatccaagaaatttggagtagtgccgtttcagattaacgattttcgacttttcttcactgatttccagtttgagccggtcttgcagccacagttttacagcaatgaatactttttctgcatcactgcgtttccgacaaaataacttgaaatcgtctgcatagcggacaatatgcacttccttgagtttagtggtatttttgaaagcaccataaatcgccgttttattgattgtgccatttggccgtacttcacagctatactcatatttggtgggcatattctcccattgggaggcaatccaccaatcaagttcattcagtacgatattcgataggagcggtgagagaatgcctccttgtggcgttccttttactggatgctcaaccgttccgtctggcataataatcggtgcttttaacatctctcggatgatgcacaatagctttttatcccgtatacccatatgccaaatctgctgtatcaattttgtgtggttgacattatcaaagaaacccttgatgtctacatcgaccacaaaatataacttttgcagatttatcatcttgtagcactgtgcaatcgcattctcggctgaccggtttgggcgaaagccattgctccgctcataaaatttagcttcgcaaattggttccattacctgcaaaatacattgctgaaccaacctacccacgattgtcgggattccaagaggacgcattttgccattgggctttgggatttctacccgcttgacaggctttggcttatagtacattagctttctctgcacgatacggacatactgctctacaggaagtttttcaatatccctgatagtttgcttgtctgtaccggctgtatagctgccaccattccgctttatatttcggtatgccagccggatattttcttcgctgctgattatgtccatcagctttgtaaagattttaccttgctggctttccgcatacagtcggtcaaatactggctgcaaatcgtagtattctgagtgccttagtttcttttgctttgtcataggcaacaccccctctgggctgtttttctttgtcatactcgaagctatgaatgttcttacctataactattttttgtaatgactggtggctgttgctccgctcccattacaggagcatctttgctcgtgccaccactttcacagcaattaaaggtgcttattttcttcgtcaccaccgcaatcatgcgttatgctgcttcccacgttccgataattctatctatacatatatacttaggtgcttgctctgagcctgccagtccaacagtgcctgtaacactgtaaggtgtttcgtaactgccatttctactaaacctcgctggctgccgtttttcagaccggcgcacatttctatacgctcctcggtttagacccgtacattcgtaagttcgtcaggtatttctaccattctcaccatatatattttgtagacccccggcatataggtcacagcctccacctctggagacctttcgtttgcgttgtatcacagccgcaattacggtgactctctgccgacttcaccgagcttcagaccgcatttctgccgcctgtcggagtatcagagtaggcatttcagggcgttaccccgtcattctacctatcgaattatcagttctataaagcatagtcctgcggctcctttcaatccacagaatatatttttaatgtgctttacgcctaaccttttcagttaggaacgtgtcgcacgacagtccaggtcatgaagtgccaccagacggtcctgcacattggtgcctgcgcccatcttggcggtgctgcccaaaaggacacgaacctgaccggtacggactttagagaacagctcctttttccgcacttcggtattggcttcatggataaaagcgatctggtcggcaggcatcccctgggcaatgagtttctgacgaatatcgtcatataccgtaaagaccggttcctgctccggcagaggcacagcgccttccaatgcgtgaagcagtggattatccagcgttttcgccgccttgcttgcaggagctttggcctgtggtgtagaaatgtcgcagaacaccagctgggtcagcttgtcagctttgccgtcccgccagatctgcatgatgttgtccacacactgattgacctttgtgccaggttcgtccggcagcatctggttgacgatcctctggtcaagccccagcttacggccatccgaggtaatcttgagcatgttatcctgggacgggtcaacagttccgctgtgtaccagcgatgcacgctccgaaagagctttgaccatttcctgctgatgttcggtaggctgcgccacgatgttgtggtattccacttccggggtaggcagattcagctggtcggcagtcttaatgtcggccacttctttgaacaggttcatcagctccggcagattaaagaacttgctgaatctcgttcttgcccggtagccggtgccttccggtgccagctccaatgctgtgacggtctccccaaatcgggaagcccagcagtcgaagtgggtcatgttcaactcttgcagacgttcatactgaaggtaacgctgcatggtgtaaagctcggtcatggagttgctgaccggggttccggttgcaaagataacgccacggtttccggtaatctcgtccatatagcggcacttggcaaacatatcggaggatttctgcgcgtccgatgtggaaagaccagccacattccgcatttttgtgtatagaaacaggtttttatagttgtgggcctcgtccacaaacaaccggtccacacccagctgctcaaaagtcaccacatcgtcttttcgcccctcggcttgcagcttttccaatctggcttccagagatttgcgggtgcgttccagctgcttgacagtaaaacgctcgccgccgctggcctgcacctctgcaatcccctcggtgatctcgtcgatctgttcatagagaagcctttcctgacgctcccggctgatggggatacgctcaaactggctgtgtcccatgatgatggcgtcgtagtcaccggtcgcaatacgggcgcagaacttcttgcggttatgggtctcaaagtcctttttggttgtgactaagatgttggcagaaggatagaggcgcagaaactccgatgcccactgctcagtcaggtggttgggaaccacaaagagagatttctggcacaagcccaggcgtttggcttccatcgcagcggccaccatctcaaaggttttgcccgcgcctacttcgtgtgccagcagggtatttccgccatacagcacatgggcgatggcacttttctggtgttcccgcagggtaatggccgggttcatgccgccaaaagtgatatggctgccatcatactcgcggggacgggtagagttcatttcttcgttatactggcgcaccaaagtctggcggcgctccgggtctctccagatccagtccctaaaggcttcccggatagcctgctgtttttgggcagccagagtggtctccttggcgtttagtacgcggcgctcttttccgtctgcgtcctctatggtgtcatagatacggacatcccgcaggtttaaggaatcctccagaatcttgtaggcgttggcgcggctggttccgtaggtggtataagctgccacatcgttgtaggatacagaagatttccccttgatctgccattcagcagtaaaggaggaatagttgacctcaatgctgcgctggagataaaacggggtgttgaaggtctcgtacataaactgctggatgtactccttgtcaatccaggtagcgcccagacgcacctcaatttccgacgcatccaggtctttgggctgggcggcggtaagagcttccacattgactgcaaaagaagggtcctgctgtgccgcccgctgcgcctgacgcagtttgcggcgtacattgccggaaaggtattcatcagcagtcacataatggggtgtgccgtcctgttccagctgtcccggcacacggaagatcacgccttgcagttctccggccagtgcttcttttgtttttccggtaagccgactcatatagctcatatctacgcaggctttttccgagatggacaccgccagtgcttcgcttgccgtatccacagtagccactgcctgatggggcttgatggtccgtttggtgaacatgtccgccttgcgctccagctttccgtcctcgtcgataacttccagcgcacagagcaggtaataggaagaatcatctgcataggccagccggtttgcacggtcgttgatgagaccgtatttggcagaaaagctgtcatagagtcggttcagttccgcctgtttttgggtaatgatgctgtctggaaccgctgcatccatctgaaggtcgatcagttcctgcacacaatcacgcagtcccacaagacctttcacacgggcttcggcggtagcgttgagatcagggcacaccatgcggctgttttcccggtagtacacctgcccgtctacaatggcataagaatagttcttcacattggggtcggcaggaatggaggtgtcaatggcttcgccctcgcccagctccggcagctctgcctcctgataagtgccatgaatgtacttcacagcatcatgcagctggtcggaaagctccagtccctcgatagggttcacggtgtaatccataccatgagcagtgcttaccggttcctgtctgcccagcaccatttccgggtggtcgataaaataccggttgatggcaaacccatcctccgtttgtccggtctgagtccattccggcgcgatgtccagcggacggtcccgcttttggagaaagatgatgtccgataccacctcggcaccggcattctttttgaacgcgtcattcggcagacggatagctcccagcagctcggcacgctgggcaagatagcggcgcacggtggaatccttggcgtccatagtatagcgagaggttacaaaagccaccacgccgccgggacgcacctggtccagtgctttggcgaaaaagtagttgtgaatactgaaatttagcttgttgtaggctttgtcattgacctgatactgaccgaaaggtacattgccgatggcaaggtcaaagaagtcacgcctgtcggtggtctcaaagccgcctactgtgatgtctgccttgggataaagctgctttgcgatgcgcccggaaaccgggtccaactccacgccgtacagatggctgtttcgcattttctccggcagcataccaaagaaattgcccacacccatagacggctccagaatatttcctgtctcaaatcccatacggtccaccgcttcgtagatggcctgaatgaccgtagggctggtgtaatgggcgttgagggtagagcttctggcggcggcatattcctccggggtcagcagttcttttagctgggcatactctaaagcccataccggtttctccgggtcaaacgcatcagagagaccgccccagcccacatatcgagaaagaacctcctgctgttcggggcttgcctgctgtccggcagcttccagctctttcagcaaacgaatcgcattgacatttgcctggaacttggctttcggaccgccttcgcccaaatgctcatcggtaatgcggaagttttttgcattgcggcgcaggttagccttgtattcctcataggaggcttcctcggcagcttcggcattggggaaggtctgccactggccattgacctgaatggaaaccgggtgttcgtccagcacttcctcaaaggttttctccggctctgtcacaggcgctggtggctccggctcctcgatatgcagtcgttccaccaccacatcataaggcagattgttcttatcgcccggatagacggccatggtctcggaatggaaggtcggggattcggcagccggttggggctgttcctgtcccaaaccgtcctgctgacgggcgtacatcccgcgcagcaaaggtgcaacctcatcccagcgaaaatacagcatagccagacgcttttcctctgcatccatgacttccagttctatgccctgtgccgtggtacggtaatcggcaatatcgccggtctccagattcagtgtctcgatctcaccggaataggctctgctcagccagtaggcgatctcgctgttgctcctgccggattgcagcagcgtggaaacctgttttttatctgcttcatccatcagtccatgagccaatacatcccgcaagtcctgatctgccttgtccgggtcaataggaagaaactcggtatagtaagcattgcggcggtctgcccgaagcagctgctcgaactgttctttgcgctctgcccggtagatgggatataccatcccggtgggcagaagctgtacggtgtcctcccgtagctcggtgatctgataggcgtcatcctcgatatacacggtatcgcccacggcataaaccggggcggcaggatcataggaggttctttgcggagtcgggcggcgaactgcatcatattcctcatcggaaatggaaacctcggaagtctgttctgtctcggcagctgcgatctgctcggcatccgacatcacctgttggataaacgggtcattgtccagtttttccgggtctgccacctgtccgttgacgatccctctttcctccagggcttcccggatggcgatagggtcgatgtcgtcaaaacggttctgttcttcttcggtatagaaccggtcctcctgaatgagctgggcaatccggcgctgtaccttcggccagggcagctgcgtttcctccgggctgccggcacggacaacgaacaggctgttgctgttactgccgccgtattcctgagccagccatgcggcggtatctttttctcttgcatggtctttcatatagcggacaacagcgtgtttactctcaatattgccgttccatgcacaaagggcggtatcaatatcctcctgagaaagagggcgcagacgctcatggagctttggataggtttcgtcgatcacttcccggtgcagacgctgacggaactccggcacatcggaatagagccgaatcagctccatatccttagagccaagaaccgcacggcgcacagcggcattgccctcgatgacagcattttcacggtcggaatgaccgcaggcatttcgatatgccacatcctcagatatggcggcagtcaccacaggcttatactgctcaaactgctcccgaagggtaggctttggcgtttcttcctctatctccggctgctgggcatgaatggcatcttcttctgccagatccttttcagcctggatcttgtcatactgcgcttgttcctgttcggtaagatagcggcctttctggacaagtgaagtaatgcgcttggcaaccttttcccagttcaagtgaacatccgggcagtcctgctttttatagtgcagtcctttcccatcgtgatcttcgccgctgtgtgttgcgccggacagggcatgagagcgtccgccaatgccatactcgtctttaaggaatctcactttttccttatccgtatggttttccatgaagaacgcatagatacggccctttcctccggcaaaactgctgccgccggtcatggcggcgtcgatctcatcctcggtaatgaaatgctggacggttggcacttgggaaagatccgaagaaaagttctgcgtggcaggtcaagatccttcaggttctcccaaatttcccttggcctatggtaatgaaagcgcaacaggtcacggtcctgctgataggcagtccagaaggcggcgtattcttccttgagggtctggcggaaagccgggtcactcagctgctcggcaagccatgcagtttcttccgggaacccggttctctgaataccggacagacaggacagatacccggaatctctggctttatcgctgaaatcgtggtacagatgccaaagtttttctgcaaggagggagcgttcatagcctgccgcttctgcaagctccacattggaggcaaactggccactttccaaaagttccccgatgcgctctgcggcactctcccaggaaatgacctgggcagacctgtcataacggacagacttcccgtgggaaagatggataccatcctcggcataccatacgctcacgctgccaaggccgttgccgccgtggtacagcgttttcagtatctcggcaatctcagcggtggttttctgcttttcaaatgctgcaaccacacgctccctctgacgatctgtattgcctcccaaacgcagcacatggtcaatatcattttgggcaaaagaaaaagcagaggatgtatgcgctacattctctgcttcatctatggattggatctgctccgcttcggagaggaacaggtttagggtcagctgttgataagctccgccatcaggatttcctcggcctgagctttgcaggtgttcatcagccccacccacttcatgggatcgctggctttcagttcctcggtggctcccgcttccttcgccagctggggcatcatctgctccagtctgctctgggcggtctcgtcgatctccagaaggtgcgggtacaacttctcgctcagcaacatctggttgtagaggatgggacgatgttccttcaggtaggttttcctcatcctgccgtacttgcccaagggtttctccggctgctggctcaacttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgccccgatggtggacggggtattgaaatcaaagatcgccatgaaatcttcgtggtcgaagtagcgttccggctccagtccacagcgggacatcaaagcgtaagtgatgctgacggtggcggctgccttgaactgcactccgatgttatactcatcatattcctccaaaaaggaaccgtcaacgatatagaagaagtcctgctgatgctccgtccagtattcctcggccagttttccggctacctccgtgagctgtccggcaaggtcatcaccggaaacatcataggtgcgctccagcatggcctgcacggaatccagatggcgctcctccaactgccacagccagggagtgcgggaatgttcacgggttccggtgtcggaaatgtcaaagacataacgcaggcgaggtctgtccccggaatcatccaccagagcgattcccttggaaccgcgccttacataacggcccatcttttcattccacaaatcgtactccgcacaggcggtggcgtccggtcgctgggcatagatcatcagctgctcatggaacgggtacttgtaaaggcgggaagcagtagtgagaaaccctgcccattcctgccagctccccgtgagctgtgttgccaccttgtccgccatctgcgcatatagttcagctttggttggcatagtgttctgtcctcctttcaattttggggtaaaaaggcggggtggcagatcgccaccccatccctgcggttatgttgtttactggtcaaaatccgggtacagctccagttcggcaaacttctcatcggtcatcgcacagagcttcgtaagggcgctgtcggtcaactctctcagctccgtttcctccggcgaaagctcgccgcgcatctcacgcaaactgtcaatcagcccggtgcggctgccggtattgtaaatgcacatcaggttcatttcctcaaaagtaaagtttcccatatcaaatctccctttccgcactctttttgggtgctgtctttttgtgttctgccttgggctggcttttcagctgctccatgacggactttttcttttcccgttcctcccgatgggcagcggcagccagatccatcagggaaatgggctgaccgctgcgggcctgctgttccagctctgccaccgtaggctcttttgcgccattgttgatgataccgtcgatcatgccgtaatcgtcctccacgtccatctccgcatttttcagcggattttccggcaggaatccggggatctgggtaaaaccaacactgtcacagtaatgacaggataccttaccatcctgcttgatcgcaacgatgtcgctgacactcatggagggactatgaaagtccacgggcttttccagattgaattgctgatagagtttctccaactgctccggcaccgtgccagacgcacttagcggagctgtgtaaatgaggtcataattgctgcggtctatggaaatgtcatgggactttaaccaatccagattcataaagcgcacattctgcggatcgtcacggctcacctgatagatggcaaagcaatctctgttctgagagagaaatgcctgttcgcgttcctgctgatgttcctgacgctccatgaccttttcgtggaactgagggcttttctcccattcctcatggtccacaccgaaaagaccgccatgatccatgatttcctgcgggtcaaacaccatgctctccgtattgtcctcatgcagcacatagacggtcaaaccggcggcatccagttccagcgcccgttctctggtaacagggagcatcccatcataggagtagccatattcctgcatatccggtgtggagacctgctcatccggcatggggtattcatccagtgcctgctcctgtgcctccggcaactgggaagaagcaatcatctgactggtctctgcctgcatttgctgataggccgcttcctgcaaggtctcaatcatggacataggagcgtgtctgagcgaagtgctgtccagattgttgtcatcacaaatctggagaactgcatttttgcgggaaagctccggcatatccagctgaccaccatccagctctttcatggatgcggcatcgtaaagggtatagtcccatccgctgtcacaggactggatatgaagataggtggcatcgttgatcagaaacaaagcctcctgctggttggcatccgccccagcacttccatttccggcatggccgcagccagttcctttaccgctttttgcaccaacggattatcacggtaatagtcgattgcctgaatggtgtccaggtcaatggtctgtccggtcaaaatcggaaacggtccttcatagtcgcttccgtctttcagctcaaacccaatccctttgaccccgttcattcgctctgccggaatttcctgatagatgcggaccgcctcctccaaagacaggttatcgtgatattctccaaggtttgaaaactccatgcactctgccacatagtaagtcagattgccggttggctgctctatcggggcggtttccggctctgcctttgcatggagatcaatcccacgctctttgcatatttccttatagtggcgctcaatgtcagagatcaaagtgccggaggtcttattgatggtctccaaactggctctcagctctttcagttccttgccctgactccagcttgcaatatagccgaagctgttttctccggtctcaatgccaaaatatttgcagaccgcataggagatgctttcagcctccacttcctccgtgtggcggtctttcctctgttcttgtaaaaactgggtgagggtagaaaagccgccaacaaaattcagcccttcttcctcggtcaggatcaggcgtccatcttccgccagctccagcggctctgtcagcagaacggaacctgcatggtttgcaaccacttgttcttctacacagaccggctctccggggtcgtagtcagaaccgcgcaggtcatagcaataaacgccctccggcagattatcacggacaatccgcccattggagaacagaccggatttatcaaacagctcgatttcctgatattgctcgtcattggcaatctgaatctttttctgattgtggagcttgctgtgggcaatctcatgaaccgtggccgaaaccgtctgcacctcgctcatgccttggcgaatggcgattttctgatgatcggcagaaaaatagccgtccgtatcggcggccattgcttcaaaagtgatcggcaccggcgcactgcggcgcagagcctccatgaatgcctcataatttggcacattgccggaaagggaggaagcaagctccggcaaaggtttcccgtcggtctggcttacatcaaagaccttgaccggacgaaacatggggatttcgatttctttttcctctgtgacgatctttccgtctttatccagaatcggagccttggtatccgggtccagcttctgctcctcgattttcttcttatacggtgtgggggcgatgatggtaatgccatgctcgcccttttttacatgacgctcaaactggtctttccacttattgtatccggctaccaatgtagcgtccggcttctgcatatagatgagcatggtgttgtttaccgaatagcggtggaagcgggacatgacggacagatagcgcatatacttttcactctcaaacagttccttgatcccctgctcgatgccatctgtgatttcccttagccgctctcggttggtgggtttgttctcagccatgattttcaatctcctttccaagtgtgtgatttctgctgtgtgttctgcaacccatgccctttgttcttcttcactttcataaagaaaaaggtccaacaggtactctacataggttttcttctggattgcttccacaaagcgggggtgcggttcttcctccggtgtccggggagaatggtcaatcccccattttttcagcagatggtagtaatcggacagtacacgatagcaccgctgccggtcctcccgaaacttttgtgcctcggttttctgccggacatacctcctgcggggaggggcctgactgtcatagaccaggccaaagtcctgtgccagtttctccgccgcttcttttggggagaggtcaaagagctttgcggtaaagtcgatcacatccccatctgcaccgcagccaaagcagtggaaccgctggtctaccttcatgctggggttcttatcatcgtgaaagggacagcaggccataccatttcgtttgacctcgatcccataaaacgctgccgcatctctggtgctgaccgactgcttgactgcttcaaatacattctctgccatgtgcctttaactgctggactttctcacaggaggctggtatccggcagctttcgcacgctcactggcagctttgcggcgttctgcgctgtatggttccctgagtgatacacaccgcttggggacggtaaagttatgggcgtcctttcgggtgatctggtcggggtgcttttttgccagcagttccagcttctccatcagacggggatcgtgggtgtagacctcagccattggttctgcctggttatagaggagaatggtttcccgttccactaaagagagcttcatcggctgcctcctttccgctggtcaaattccagcttaaagttggcgtactgtccatcgtcctccaaaaccacagcggcatcgtaggtctttccggttttctccgaatataggcccgtcacacggacacggccatcgttaagcagtgcagacaccacagccttggtcggctgttttttcttggcagcccaccatttgttatttttccagattgcaaatttgcaagaatcattctgacagaagaagcctttttgcagttctgcaacttcaccgccgcagcgagggcatttgcccaccacctcacggggcggagtgaacaggtactcagttcccttgatgacctgataagttcctaccagatctttcagcatggtgctgatcccgtccaaaaactcctccggggcaagctgcccgcgctcgatctctcccagtcggtactcccactcggcagtcagaagcggcgattgcagttgttccggcagaacggtgatcagggaaactgcatcgtgggaagggagaagctgcaccgttttcctgctcttttttcgttccagaaaaccggcagataccagcttttccaaaataccggcacgggtggccggtgtccccagaccttttcgctcggcatcctccggcatatcctcttttccggcagtctccatcgcggacaacagggtgtcctccgtaaagtgctggggcggactgcttttgccttctttgacgattgccgcagaaaccgaaagggtctgtccttcagtcagctccggcagggctttctctgcaccctcttttttcggctctgcatccttcgttttggcacggtaagcgtcctccagtgctttccatccggggtgcttcaccgtttttcctttggcggtaaattccccaccggcacacgctgcaatcacaacggtttccgaatagatatggggctgggccacggcacacagcagacgcagggccaccagctccagcaccgctttttctcccgcaggaagggcagaaaggtctgcatccttgagatttctggtagggattactgcgtggtggtcggttactttcttatcgttgatgactgtctgcggatcacaggtaatggcgatccctttgcgaaacggcatagcattggcaaccagattcaccaacaccggcaggctgtctgccatatcaccggtcagatagcggctgtcagtacggggataggtgcagagcttcttttcatacaggctttgcagatagtccagggtctgctgggccgtaaatccaagcaggcggttggcatctctttgcagagtagtcaggtcataaagggcaggtggcttttcgagcttttccttacactccacctttttgattgtgacagctgcatcctggcaagcttctttcagctgctctgcgcttgctcggtcacttatgcgctccccagatatggtaagaccgggcagctccagcgccacggtataaaaaggaaccggcttaaaggtgtcgatttcagcttctcgctggacaatgagtgccagcgttggagacatcacgcgcccgatgttgagggtgcggtggtacagcacggaaaaaagccttgtggcattgatccccaccagccagtcggccttggcacggcagagagcagcatcccgaagtccatcataatctacacctgggcgcaggtttgcaaagccctcccttatggcggagtcctccatcgaagaaatccagagccttttcatcggcttttggcagcctgccagctcatagacgctgcgaaagatcagctcgccctcgcgtccggcatcacaggcatttactacctccgtcacatccggggcgttcatcagctttttgagaatatcaaactgctttttcttatcctttcccactaccatctgccaatgctccggcagaataggcaggtcatcatatcgccacttggcatacttgggatcataactgtctgcatccgcaagaccggccagatggcccacgcaccagctgacacgccagccgtttccctccagatagccgtccttacgagcagtcgcgccgatcacggcggccagactttgtgcaaccgatggtttttcagcgattacaagcttatatctcatcatcttcagcctcccattcttcccgcacaggcgtgtgcagttttttctctatgctgttttcctcatccagtagcaggttataaccaaaccggtagtcatagcggtacagtttccccagcaggtcattgatgatgatgcggcaagccaaaatgacacgggttttatccacctgcatcagttggtagcgttgataattgctgtaatattcttcgtgacggcgggtattgcaggcggcatcttcaagtaaactatctactgcatcctggcaaccatcttctttttccccttccatgcagttcagaagttccatcatcaaaggaaagctctgttcatccataggagcttctgctgcaagaaaaccgatcaaagcggataagagcagacgagccgccgtctgttcttgttccgtcagcacggccattgttttctccgtatttggcaggatcttttcttccacaaaatctgccgcatcgtcggaacaaagctgacggatagaatctatggacaatgaaactgtcatggtatctaaggagaaatcaaaggggtcatcttgctttggctttctccaaagtttgtttaacatggtagaaagaatgtcgccgccaaaatacacagcaattaccagcaggtcaaaaacagcaatcagcttgataaatataatcagaacactcatttttttcgtttcctttctttgagccagcgttccatctcacgatggcagatacctacgcagggacttccataactcccgcaaccatagcaggggtggttgtgggataaagaatgaggacgggaagtttccctcccgccctccggcctgcgtgtcatcatgcgttcatagggactgtctgtgaaacgggtcatttcacgctgtcctcgtcatcttcttctgtgctgccccatcagcgtccggttcgtccgactcctcatcctcggtttcccattcctcggaatcttcctcgccataatcataatcgtccagactgtcattgcccttggtcttaggtttattcttcatgagcttcatgtaggcaaatacgccaccgccgcccagcagagccagcagaagaatcagcgcagccggatttagtccggcaggcttctctttttccggctccggtgtttctgccggaggttccggtgctttgcccgtacatttactcttatcagttacacagacctgacagcccgtattgactgcccctgcttcacattttgccgtgcagctgcataccgcaggcggctcctcttttgcttttccatcttccatcagtgccatcaaatccgcttcatccacctgattcagaaagtgaacagcagtctttttatcctcattcgccctgtcaatcaggatgtaaaagtaatttccagctttggtcgtaacagtaataagctgcttattgcctccaaaatcatccaccagtgccgcattcccctccggtgtaagtgccggtgctggttctgtttcttccacagtaacattgctgtcattggtagaatcctctgccggtgccgccggagcctgttctgacccctgtgcaaaagcagggatcgtaaagccaaatgccacaaccattgtcaggcaaagggcggaaagtgttcggagcaatcgtttattcctcatagctgttttcctcctgttcgttattgtcatcagccaaactgccgggaactgtgccaccggacagcatggcgctcaactgggtcggggtcatacgcagggcgcgcaccatctggacgatctccagattttctgcctcggttttctgtgcttccagcgccttgagcttttcctgatactctgcgatcttctcgcggacctttgtaatctcctggtcaatgcgctcaattttgttctttgccatcgtctatcactccttcttaaaaatctctgttaccagttcatcaggccgtagcccttaatgctttgataattcaggtcataacttttgatcttgcaggcatcgccggaatttccctccacggtataaacacggctgccatccgtaccgatcacgatacctacatggtctgctgtcccatccaaatcccagtcaaagaaaattgcatctccgggagccagattgttatagcctcttgcaccccattgtccatgggactggaaccacggaacgccctgccactcacagcctgcaaagcgcggttcactttttcctgcctggttatagcaccaggatacgaagcaggcgcaccattccacacgggagtcaaagccgtaccagctccagtagggataaccgcccacattgcccacctgacgcttggccagttccaccagctgaggattgccggggcgggtaccgttaatgaactgcacaccggacagatcttccgagccgctggtatcaggggagccgccgccaaacaacagcggcttattgcccatggtctgccggtaaacctgatacattttcatctgctccggggtcagaagctccgacaccacagcggaaatgggcttgctggcgagtttcacattcaaaatgtaatactcatagggaacttcttctgaggtggtctcgccggtctccggatcggttgaggtctccgtgcggtagcgaatctccacttcctcagtaagcgtcagctgatactgtgctgcaaacacacgcgccagctcagcctgagcgctctgccgggtgtagccttgcaagacggcagagagaaatgccgccagctcatgagggtcatggccgatcataccaaggtcatagcgatactcgtcataccctgggtgactgctttcaatgttgtcgatttcctcctgcaactgggcttctctggctgcataatctgcctccaccgccagcatttccgagtcatccgacggataggtggtgccggagagaacggaaccgatgctctgcgccatcatggagcaggaggacatggtattcatcagcatacaggtaatgaggaacaaaacccctgccatcaggaaacccttcttgtggcgcatgacgaatgcccctgcctgctgtaccttttcttttaccgtccttgcggcttttcctgttttggatgcagcctgggcggtatttccagcagtctgaccggcatgtttggcggcggcatactgctttttgatggcctgcttttgctgccagcgggaaagtggattgctggcaaactggggattttcctgcaaagatttctggtacagaacatttacatttgccttttccagttggcgctctgcctgtgctgctttgcggtacggcttcagcttgtggctgcgatagccctcccgcaccagataagcgccggtctccaccgcttcctcggacttgtgggcgctttccacgcccacattgtcctgttctgtttcccggatctctttgtggagcttgcccgcaaccagatggacgggagcttccttgaccccttgagaaagtttggagggtggctttttcttgtcctcaaaggtcagcttcgaggtctttttcccggtatccgggtcgatgaccgtctgcctgacctttttctttgggatattggcctgcgccttatctgctctggccgcagctttctccgctttacggatcggcttttccagtgcagggtcagaccgttcctcatcagtaaagcgcaggcgcggctccttattcaaaccattctcccagcatgagggaggacatcatgtagtgcagctctgcataaatggccattcccacaggatcgttgaacatacaaccggacaggtaggcgtaaaactgtgccaccacatcggacaggattttcgcttcggttccttccagaaccagaccacccataccttccttggcacggatggtgctccagacctctgccagacggagcagccccacctgaccggtctcattcagttcggctgcctgatctgccgccgtgcggcactcacttaccgcatcggccatgaccgtaagcagctggctgcgctgggcatttaccgccctgtcaaaaaacatcaacgggttttgattcaaaatgttggggttcatcatcattcatcctcctttttcagttcctggggtttggtggtcataatgcggtacagctcggtattcttcgggaagtggtccacgaaaggcagaattgtggagccatagaacagcaggccctcgccctcaccggagtgggtcacatagctaagctggtgtgtggaaatgcccagctgcttggcaagtatctggcggtctccgcctgcctggttgagcatatacacgaagtcggagttttcaaagatgttctctacctcgcggctgctcaaaaggtctttgacattctgggtaatacctgtcggaataccgccccatttacggaatcgcttccagatttccaccgtataggcagcggtctgttcctccttcaaaagcaagtgcatctcgtcgatgtagtaacgggtagacttgtgggcagcgcggttaatggtaacgcggttccacacctgatcctgtaccaccagcataccgatttttttaagctgcttgcccagttccttgatgtcatagcagacaatgcggttgttgatgtccacattgctctggtggttgaacacattgagggagccggttacatagatttcaagggccgtagcgatatactgagcttccttttcctcctgttcccgaagcaggttatacagatcctccagtatgggcatattctccgggcgcgggtcattgaggtaagtctgatagaccagacgcacacagcggtcgatgatggttttctgcaccggctgcaagccctccttaccgcccacgatcagctcacacaagctgagaataaagtcagacttgagggacagcgggctttcatcatccgagtagtccaggttcaggtccatcggattgatgtagttggtggaggtaggcgagatcttgatgacctgcccatgcagacgctccaccagaggtgcatactccgcttccgggtcacaaatgataacatcatcactggtaagcaaaaagcagtttgcgatttctcgttttgcgctgaaggacttaccggaacccggcgtacccaaaatcaagccgttggggtttttcagcagctttcgatccaccatgatgagattgttggacagggcgttgatgccgtagtacagagcttctttgccgttctggaataattcctgtgtggtgaacggtacaaagatggccgtagaactggtggtcagtcctcgctggatctcgatctgattgagtcccaggggcagacagctcatcagcccttcttcttgctggaagtccagcctggtcagctgacagttatacttctgggcaatggagcctgcctggaaaatgttgttgccaagctgacggggattgtccgctgtgttcagcaccagaaaggtcaaaaggaacattctctcgttgcggctctgcaaatcctgcaagagttttttcgcttcactgccgtatgtggcaaggtcagagggaatgatgtccatgtcatatccggcgcggactgcttttttctgttcctcaatcttactgcggtcaaggtcggtaatcttgcgctttaccgttttgatggctttcacctgatccaccgactgaatgtgcatactcacaatgagcgagctttccatatccagaaaatcagccagcagacggtcattcagctccggtgcgagaatctgcaaaaaagaaacagccccgtatttcttgcccatacggaactgcttgccggtgcggaactcaaaggaacttggtgcaataaaatcctttgtggacagaccggaaggagccagccagtcccattcaaactgaaacgggagctgttcatccatgtggaataccgcatgaagctgagaaagcctttctttaccgtccagcgttctggcagctacaccaagacgcttgaagttgttgagtatatcggtctcaatacgctccagacggggcttggcggctttgatgctgtctgcgtcgataccaaaggtcaggtatttggtcttgatgagaccgttgttacctcttgccagctgattttgcagcattgtggtgtattcctcgcggatactgtcaaaggcatccctttggggcgggatggaaatggagttagcaaaggtctcctccgatgccgcaaggttcaaaaaagacagttggaaatgaatcgagctgtcaaaataattgaggaaatcacaccaaccctcaaagattgccgtcttatcttcgttttgggagagttgatagttgatgtcctgaaactgaatgatctttgtgtagtggctgtccgatatgcggcagatcccgtccggccacatccgttcataagggatactgtcctgcgcagattttccttttttgtccgtgcggttggcgcggacaatggccgcttcgatctgcttcttatcggcgcgggacagctttttctttgtctttaccggctgcacagttttttcctcggttttcccgaacatccgatgcagccatttttttattgcggtgaacaatgtcatacacctccttatcgagcatttcctgccgctttaatacggcataaaagttattggtctggtagggacgctgcttgggacggatcacagctactttgagaatgttgcccacgatcttttcaaggggctgtccatgcttttcgtacatagccagcataaagaagggcagcataaccagcatcatacacatagccgctacactgtttccggtaggttttctgagcaaaaagaaaagcggtacgccaataagcgctccgcccgtgaaacagataagctgccgcttggtcagattgaacatgacctttgttttgacttttgttaagtccttgggtacgggtacataagccaatgtggaaacctccttccgttttagtgcgcctgaaagactgatttggcgagactgccggttttgaacagcgtaaaacatagcagtacggtgtagcccacgcagctccagattgccatgatgatgtcatcttccagagcgatgttctgcaccagcacagcataaattgccacgcagacgataatgagaaacgcctgaaagcccagcgccagcagggatcggaggtaattctgtcccataccgccccattctttacccatcattgcagccattggaacgggagccaccgaagtcacaaggtaaatctcgatcatacggccataaataacgataaagatacagatatataacgcccacatagtaatgccaataaagagggattggaaccacagtccgaacagcggtcccagatccatttccatcagcctcggttccagatcggtcataactgaggaaatgtcaatggacgcatccgaattgataacccctgccgcctgcgccaccacgctctgcgccatatcaaagacgcccatcacgatattccatgtgtttgtgacaatgaggatggcagcggctgatttgaacacccacttgaaaatcatccaggtatccacatcatgcaggttgttcttgtctgcaatcatctggatcaggtctacggtcatcacgatagccaggatcacgcctgcaatcggcaccatgatggagttggacagattctcaatcatgctgaaaatactgccattccatccctgtggggtctggcctacctgtacggatatatccgcgacctgctggtttacactgtcaaacatccccgaaaggttgctcataatgccgcccaccagcatttctttcagccaatttgtcagggcttcaagtaagaaatccatacggtgtcaacctcctttccgccgcccccgcaaaactgcgggagcggcaaggatttcatacggagacgcttagacagagaaaagcccggagagcagaggtacaaggaccatgccgactacggctacaccagcaccggccatgagctgcttcatgccctggctcttggcgccggatagcgataggtaatcctttgaagttatctccagattttcccccgctccacaccgtgcatgcgactttcaccgcacacggcgctccatcgaattcagccgtccagggttttaaacacaacttacacacttcgttacagcattaaattcaaagaataataggtggcatttctgccatagtacgaagtttgttaagcttttctatttgtttatcgtcaagatttaaggatttcaagtacttctcaatcgtaggttctgaagaagcatggataaggatatgaactgcttcgctgacaagaataagatttgcgtattcatccgaaccaccattgcttacgggcactttatggtggcagtgaatatcatgagaatccatcagaattcccgtcactgcacatttaccatactgtgccgcatacaaggaaatacggttatccgcatattcaatggttctgccctttacaggatttctcatcagccataacattgtcgctgtatcgattgcaagattcttatgaatctgttcccgacctttgaccgtatacttattgatggatttccttttatgctgggcattcttcggctggacatatcccagtggaatcaccggacgtccatgaaggaacctcatctgtctgcttgctccatacttttctttaataaacccatttctgagctgtccctttttggataagtcacctttcagtctgtttctgagctgtttgttgatactgaaggcaagtctgctgaaatcatgggatacttctgtagaaatacaatagtattcatgaagtccggcaactacagcgttatatttctgaagctgcatgaactgagcattatcatctgacgaatgagccagtttctttacttcttccgagacttttccatgagcctttttgtatgctttatcgctcatatgagaccgaactacatacttcttaccctttttacggactttcagcttgaacccgagaaaatcagaatactgtcttttgagattaactactttggatttgtcagggctgatttccaaccccagcctgtcctttagccataactctgttgccttgtatgctttgacagcatcctcatgtgatgcgcagaaaattttaaaatcatctgcgtaccgaactgcatgcatctcttttaatctgctccggcgcagagctctgtaagcgtggctcttaatctctgttccctgcgcattgttcctcgttttgaattttgtccttgttggcatctgctcccattgagaagcaatccaccaatccagctcattcaatacgatatttgcaagcaatggcgataaaataccgccttgcggagtaccccgtgagggatatgttttctccccatttggcagaacaacaggtgctttcagcatctcttttataatgcataacagctttttatcccggattcccaatgcccatatctgacgaatcagctttgtatggctgatattgtcaaagaatcctttaatatcgaggtcaaccacatggtacagatgctgtacctgtatcagccgcatgcattgcgcaatagcagtctcagcagaacgattcggacggaacccgttggagttctcactgaattttgcttcacatattggctccatgacctgcaaaatacattgctgtacgatccgatccacgataattggaattcccaggggtctggtctttccattgggctttggtatctccactcgccttacgggtcgtggatgataattactgaattgtttccgtatgagacggacgtaagcttcctcgcttaactttgcaaggtcggctatcgtccttttatccactcccgaagtatcacttcctgtattcttctttatcgttctgtatgcaagtttgatattttcttcactctcgatgatttccatcagatggttgaaggttttatttctcttactttctgcatacagcctgtcaaaagtgccttccatgtcgtaatactctgagttgcggattttcctctgcttacttttcctttcttgctgccccgaagtcaacacaggcatcctctcccttcggtttggattttctttgtcatactcgaagctgtgtttgttgtgttttcattttcattgctgaattcgacttgtggctatccctccaccgcttacttattcacggcttcacaggtactgtgccactactctcactggaataaagaatggttattgccctctcacgaaggtattcccatccaccacatcattggcttgcaaccgcctccgtgttcccagctttccacgttccgatattcctatcattgaatatctttaggttcttcctctaagcctgtatctggtcatgcataaccgcaccgcctgtaacggtgcatggactttcataacaaccaattttactcgcccacagataccaccataaaaggtgtactgcctttcgacagcatcaacgtttagactcgtacattcggaatttcgtcagtattttcatacattctcaccatggatatccgacccccggcatataggcaacaccatccacctctggacagctttcgtgtctggtctgaaaaccagtcttacggttgctctctgccgacttcaccgagctctataaacttttggagagagccgttgcatgctccccgccattcggagtattagggtggcgcttcgggacgttaccccctcatttcacccatcggaatatcagttctccaaagttttgggctacaattgcccttcgactttgtgcgcaagcttttcacttacgaacgtgtcgcacggttgtcgttgccgtaaccttccagcaggttgataacgccccagataccgagaccggcaccgagcgcgataacgagggtctgaagaacggtgattgcctgttcaaaaaatgccatatagtttgttagccggaatctgattaaaaaataggtttgtcatgtttcataggcatacaaaagccggaacaatctgccgcccggtttccgggggcatgattccggctgtcctcctttttcattattttttctcgcgattgtccgctttgtacgccaatggcccatagagggcaggtgcggcgaatagataagatcactcccttctaaagcggaacgaaattaagcgccctttgtgtctacttcatatacatcgcagacctcattgggcttgagtttcagccttgcagacaagaatgcttcaatgtcaaaagcgttcttatcatccgcgtcggcagtgtacttgaaattggggtgcttggtgatgtcgtacttatccgaaaggaaaggacgcacaccgcgcagctggaggatacacttgcctccatccataacagcaagctcatcctgactcatcagctctttccccaatttttgatagttgagtgaatgggaggtttccctcccacggctctctccggtgttgtaggtgtcgatggtttccttgcccagcacggcagccagctctttgagggtagtcggctctttaccgcccaggaagatggatgtatccatgttaccgatgatggtatctgcgttatccttatagatcgccttgagctgactctgtgcctgcaacaccagacaggcagagatttcacggcttcggatggtggccaccagcttttccagtttcggaatctgcccgatgttagcacactcatcaatcaaacagcgcacatgaaccggaagcctgccgccatacacatcgtcggctttttcgcagagcagattgaaaagctgggtataacacatggagatcaggaagttaaagctgtcatccgtatcactcataatgaggaacagagcagttttcctgtctcccagagtatccagctccagctcatcataagccgtgacctcacgcaactctgcaatgtcgaacacggcaaggcgagcgccgcaggaaatcaaaatcgacttggctgtttttccagcggccagcttatatttcttatactggcgcaccgcaaagtggtttggcttctcggcttccagtgcatcaaacatcaggtctacggggtttttgaactcctcgtcatcctcacggacttccatagcgttgatgaactcaatgagggtggagaagttttgttcctccaccggagcctcataatggatatagccaataagcgcgcagtacaacaaggtttctgcttttacccagaaatcgtctccggccttgccttcgcctttggtattggcgatgagcgttgttaccagcttcaagatgtccttttcgctatggatataggcgaaagggttatagtgcatggacttcttgaagttgatggtatttaggaccttgattcggtacggctcataaatgaccttgccgtgcttatccttcataggctttccgtctttccccagcttgggtgcgcccctttggagcatttttccgcactccaccaaaatggttcccttcgggtctgtgaccacataggaactgtgcatctgcatcagattcggtttgagccagaagcgggtcttaccggaaccggagccgccaatcaccagcacatttttgtttctggcggtctttgggtccttggggcggctgttcattgtcaggctctccgttttcgtcagaatcacattgttctggaataccgggtcgatgtagggtgcaatgtcctcatgggttccccaacgggcggaaccgtattccatgccgtgcctgtacttcttggcgttcttgcttttcaggtacacagccagccgcaggccgccgccgcagcacaggcccaccagcaggtccagcgggtgcaggctgggccaccagctggccagcgccaccggcagcgtggagaagaacgagagcatttttgccgaagcgtccgcacccacggccatccgccacgcttcaccgaagttggtggagaaaagccccatcaggatatacggcagattcagcaaaatgagctttttgatgttcagctgctttttcatcgttccagctccttccgcttgttccggtccacgacggcgtgttttaccagttctttgaactggctcagctttgccagcacggacgggcgctcggatttctccgccttcttgacctttttcccggtgtactcggtaaaagcagcggtcagggcatccgcgtcccgtcccttgaaaaagatcaggtacttgggtggggagctgctgcggtccttcttcaccgcatagtccacgccgtatttccgcgcgatcttctcaaactccttgatggaggggtcagtgatctcgatgttggaaacgccctgattctggccgatcagctgtttcaccgtctgcttgccgtggggaatcacgggggtatcccggcttttctgcttttgcagcttcttttccttgcggtgggcaaggtatttggtgatggcggctttcatcaaccgcccggtaaactttgttccgctgactaccagcgtcaaagtcctgttttccacttcctcctgcataggtcatcgcctcctttccacggattttgcaggggtggcacttgatactaaggcgggaccaccagccgccgcagaagataacgcttcataccgccctccttagcgtaactggtcagtacggtcatagtgcagattgccctgacgcacctttgcgtggctcaaaatcttaatctgccccttttcctgactatccagtgctttttcataaccggtatccgacaggaacaggcgggttcgttcgcctttccagccaacaggggaatcgttcgtcagcacatcaaaaataatcatgtgccgggtgtcctcggcaaaccgttgcaaatccatgtattcgtggccgtggtagttctgcgccccggctttgaggcgcatttcctccatcagctggcccacggtcttacgctcaggcatggcgtgcgcctcctttcccgcgtccctggcccttcacggccaggataccgtccagggtggtggcggtgatccgcaggcgctcggcggtggcaatgtcattcttcacggtctcgtcgatgccgtggccgcagaccaccagcacatgggaccggcgcaggtagtcccgcgccatatccagcccgtccttgtgttcctggggaatctcgtctttgaggaaggtaggcaggaacagcaccgggcagatgggcgaatacccggcatcgtacacctgacggcagtaggccgcagcgttctcggcgttctcatactggctgttgctccagggagccgtaatgtaggcaagaggtcgtttcatggcaaaatcctttctcccggtgttttcgggcagcagaaaagcggctgtttaccagccgcctgcgtacatatcgtggttaacttgtgcggtgtagtggttgctgatcgtggtcggcgcattaaacagcaccgcaagcagatactgcttcatgttgcggatttcggtggtattgttccgcaggcattccatgacaaactcgatgtgggagcaatccagcttcaaaaaacgggagcggaccacctcatgggggaagtcgctgccagcgatccgggtggttttccgcttggcgcagacggtctccaccatcagctccacaatctcgtccaggtcctcccgataggtggtaaactcccggcacaggtggtcatactcgatgttctccagaatcaaatcccgataactttccatctctgagacagacatcgcatcccttcctttccgttccggcagctgtgctgccgctggctcccggaagggaatagaatcggtacttgatccataagtaattgttttttctgtatttgatttctctatatttaattctgcgggcttttccgtatccggttttaccatatccgggttttccgtatctggtgaagccgtatccggctggggcgtatccgggttcttcggctgtggttgctcgtagataacatactcggtatcgctgatccgaccctgccggtctcgcagctgatggcggacaatgtacccggcagtttccagctcccgcagcgcgccgccgatagcgtccacgccctctttgcagatggcggcaagccctctggtggtatagttccagtcctccggtaaggacagcatcatggaaagcagccccttggctttcagggacagtttcccgttgcgtaaatggtgattgctcatcacggtataatctctggttcgttcaatgcgaaatacggccattgacctcactccttccaaatttctcagggtatgaaaaaagccacaatcctgtaaaaagaattgtggcagtcagctgttttgttcactttttctgcgccggtaggggcgcttgggaatgggcggtctgtccaacaggtcatttccctgagagaatggcagagtttgcagaacacggtcaatctctataaattccataccatgctgggaatggcaatcctcccggattgcttcccggatttcctttacagtacacatttcaatcctttcctttcgcagtaatgatttgtttatgagtggcggcggtgttttcccggtttgaaatcgaggatatgtccctcaatcacacgagcgtaacgcttgatcttgatctcccgacgctgctggctttgcagggcggcctgatacccgtcctcagtcaaaaacagtcgtatttcctctccggggctaccgtaagctgtgctgggacgcaggacggaaaactcaatcatccagcgggtgttatcccaaaacctctctacggcaagaatgttatgtcctttcagctcacgggctgaaatatccctcataggcggctcctttcatcgttcctggtctctctgacgctttttctgccatgcctccagcagcttgatgatagtgtcctgcatccgctggggcgtatagcttttagggaaatacttccgcaaggtgtcagaggtaaatgtcactcggtccagatcgcttttcttttcctcacccatgatgacacgcatcatatcgagggtcagatgcccctcctgactgtatttcttgagccgctgggcttgagaaagagaaggggtagcctgttcgctgtccattgcatccagcaaatctctctgttcctcttttttgaggaaggacagctcataagcaggatttaaggcaattttcttttcatccaccatgtccagcagttcgggaatcagctcggtcagacggataaatcttttaatctgtgatttgctatctggactgttctccgcgattttttctgccgcagtcaacttcggcccaacttgggccgaggttaaatccgtcctggctccttggtgcttaatggcatccagtttcatcttataggcaaaggccctttcactgggaagcaggctttctcgttgcagattgctgtcaaccataatgatcgtggcggcatcatcatccaaatcccgaacaatgaccggtatggtctccttgtctgccagctcactggctctgtgccgcctgtgtccggctaccagctcataaccgccctccgggtccggtcgagcaatcgccggaaccagaacgccatactgcttgatactgtcagcggtctccatcatggcttcgtcatccttgactttgaatgggtggttcttaaagggatgcagttcagacagcggaatctcctgaatcttttccagctttgcatcctgacggacttcttcggtggagaacagatcatctaccgaggccagctctatttttttcgcgctgcttttcaagtttcaacacctccttcatcagatttcgatacccctctgccaccttgccaccgggatcatgggcaaaaatactttttccctcagcgctaatttccttagcccggacagagtggggaatctctgtgccgaatactttgatcttgctgccataggtctcacgcaggagcgcggagatctctttggcaaagttggttcggctatccaccatcgtcagcaggataccgtctatctggagcttggggttgatctgccgctttaccttgtttaccgtggagagcagctgttccagccctttggcgggcagatactccgcctgaacgggaatgatgatcctgttcgcagcggccagcgcattgactgtgagcatacccagggagggctggcagtcgatgaggatatgggagtattgccccttcagcgtgtccagatattgccgcaagatagtctcgcgactcatggcgtttaccagggatacctccataccggataactggatgtccgcaggcatcaggtctacaccctctgggtggtgcaggataccctcgccgggacgaagcggctcatccatcaggatacgccccatagcgtccgacagcgtaaagggcagcttgtccggctggggatggcccaggctgattgtcaggctcccttgcgggtccccgtcgatcagcaggactttctttccggcctgcgccagcccgattcccaagttggcacaggtcgttgtcttaccaacgccgcctttctggttggcaatggcaatgatttgcgtgttcattaacttcacctcatttctaattgttgctgttgcttctggaaatagaaaaagccgccactccaaaataaaaagtgaagtgacggctctttctatcgccggaatacgagttcctgaaatgaaaaaagcacccagtcatttatgtgatctgtgtgctacatcaaattcatattcaattattcaaattagctcaaactatgccaaactgccacagccaaaaaaacgaggggaaggagggctgaaaagcgcccccaaaacacccccaaaatcggctctcggttaaccactttgggaaccacttgaccctctttttaccccctttttggccggttaaccacttgcggaccactaaaaattgggtgaaaacggctctcgttttgtcaaatttggtcaaaccatatcagcccatttaggtataagaaaaccccggaaaaccttgattttccggggtttttgaaccattttgatatagtctgagcagtcgattatcgcttgctgaactgcggagcgcgacgagctgctttgagaccgtatttcttacgctccttcatacgaggatcgcgggtcaggaaaccggccttcttcaggatgggacggttgtcctcgctggccagcagcagggcgcgggcgataccgtgccgcagggcgccggcctggccggacacgccgccgccggtgacagtggccacaacatccatcttgccggtgttgccggtggcctccagaggctgacggaccagcatcttcagggtgtccagaccgaaatactcatcaatgctccggccgttgacggtgatggagccggtgccgttggggaacagatggacgcgggccacagaggacttccggcgaccagtgccatacagatagggcttcttggactgatacatacttcaaactcctccttattccgcgtccagagcgacgggcttctgagcctgctgctcgtagttggcgtccgcatagatgtgcagccgcttcagggattccttgccgatggtgttcttgggcagcataccgcggacagccaccttcatggccagctcgggctgctcctgcatcaggatgcggtagggggtctccttcaggccgccgatccagccggagtgggtacggtacatcttctgggtgcccttcttgccggtcagcacagccttgccggcgttgatgatgatgacatagtcaccgcagtcggcgttgggggtgaaagtgggcttggtcttgccgcgcagcaggtcggcagcccggacagcggtcttgcccaggggcttgcccgcggcgtccaggatgtaccacttacgctcaatgttggccttgtttgccataaaagtggacatggtgtttcctccgtatattgaaattctttgctttgctttacaaatcaagagctccgggttacaatcggagcaaggatatttataccacggcggcgggggaatgtcaacggggatttcgtttaaccgggataaatctctgaatttctcttgatacctcttattatctcctgatttctcacgttctattttgaatttttcgggggaaggccctgtacgccgaaacgcctgggggcgctggatcttctgcgcggccggccttatgcggattctctgcgccgctgctatggcagaagccctggggagatcgctcgctatctctgctgggagatggcggaccggggcaccggccccatctgactgccggcggtgggggacgatgggccggaccgcttcgccatgtttttgggcgagagaaaaccggacgagcgttacatcgtccggttcccgcagaatgtcgatggggactatgaagcgtatgggcatccggtgtggatgtacggcccgtacccggtgcggggcgtctacacccagcccatgagggctattccggccacggaagcctgttacgtcatcgggaatgaatcggaaaaactgacggaggtccggctgcgggtggacgcaggcctggacgaatccgtctccatccccgccccgccgtccctgaccatctggcggtttacaggcggggacatgggctggcgcctggtggaccggtattttgacgcccggggcgaagaactgccctgacgtttgaaaacaatatgtaatgctacaagatccactggaccaacagcagcagcacaaatcccggcaggcccaggacggcgatcaccagggcattccacaggttcagccccagggcgatgccggtgaggcccgccgtcagccgtacggcccccagggctagaaaccccaacagggtgttcagcagtagtttcagcgccaggcggaagggggagctgaacacccggatcagagcgacgagaaagaagcccgccaggatggcggcgatgatcttctgactcaggtccatgtggacgccccctccagcccggcagcagccgctgcctcgggactccgctccttgatggcgcggatcagatagttgcaccgggccttcacggcactgatctggtagacgcaggactccaccagctccgggtccagggcctggtcgaactggcgataggcctgggccaggtccccctgggcctccagcagctcggccttcagggtcagcagctccgggtcggggcgggcggctttcttggcaaaaacaggtttcatggcagtgtccctcctatccatattcttacggggagtttggacaaatatgccagctttcatacaaggaggcaggaagaacatgccaacagaacaggagaacttcatggcccaggctctggcgctggcggcggaggccgcggcggcgggggaggtgcccgtgggctgcgttatcgtccgggacggggaaatcgtgggccggggccgcaaccggcgggaggagaagcaggccaccgcctcccatgcggagatggaggccattgcccaggccaacgagcacctcggcacctggcggctggatgactgcgaactgtacgtgacgctggagccctgccccatgtgcgctggggctatcctgaatgcccgtatccgccgggtttggtacggcgcccgggacgaggccttcggtgcctgcggcggagtgaccaacctgtttatggagagcttccccaaccggcccgccctggtgggcggcattctgggagaggactgccgccgggtgctggcggatttttttgccgggctccggggcggagaaaaaaatcgaccctcagatttgatttaagacttttgtaacaattgatgctggtttgcttaacaactctctagtatcttaatacttgcaagagacaaaacttcttttcatccaatcttccaaaaaatagggaaacggaccagccgaaaggctggtccgtttctcgatttccccggtatttgtgaacaaacggaaaatccccgcggcgggcactcccggccgcggggattttgtgataaactgtcaggtattgtcccagggcgcggccagtaccgccgtccgctggagcaggaagccgaaaagcgtcacggcgccgcccaggtagaacagcagccgggccggatccggccggtccgccagagtggccaggcagaaggcgatggccagcgccgcatagacggcgaagcggcgggtccgccccgcccggaaggcgaaggaggacagccggtagaaggccagagccaggaacaccaccgccagcagctccgtgtagtaatctgtgagggacgggtctacggacaccacccggtaggtcagcaccagccgcaccaccaggcagcagacgggcaccagcagcagaggactctgaaagggcttgcgcgccccgccctccggccggatgcggcaggcaggcacagcgggaagcaggctggccgccgagagaagagacagcagacccaccaccagatgctccctgccggagaagagctgactgccctgggcggtcacaaaaacggtcaccgtctctccgctgccggtgagggcgctggcgccggagaagccgaagagcaggtccagaacgccggaggctgccagcaggaagagccccatcaccgccggagtgagcagcccgggggaagccacggagaagcctgcgggaaagaggggcgggtcttcccggtccgcaggcagaaggggccgggctgccagcaggcagactgccgccagaaccacgaaccaggccaccagcaggatggcgtacagattgccggggatggggaggcctgtgtccacctcgaacccagtgctgcgctgaagcagccgcagcaggaatgcccccacgccgccaatggcggccagcaggggccagagcacgtatttcttcataggagccgatctccttatcatgacagattttcaaaagccagtataccacgggaaaagctgtttgtccatgccggcctcattttccgccctccgggcgcatacagtgaagggacaggcccgcagacggggaacaaaagaggaggaatttccatgagacgccattctgatctgcaccagagcgccgccatctccgcggtgctgctggtgctgctgtttgccctgcccctggcggtggtagtgccctttcagacagagcttttctccgatgatcccatcgctgtggagtcggagcgggagccctttcagccgggggacctggacggagagatggtgctgaaggtcctggcaggggacgcggtggaggagatgaccctgggagagtatctggtgggcgtggtccgggcggagatgcccgcctcctttgagccggaggctttgaaggcccaggcggtggcggcccggacgtacaccctgtacaagatgcagactggcggcaaccacggcaacaccgcggacatctgcacggactccacctgctgccaggcgtatatctcggaggaaaacgcccggaacaactggggcgagaacgcggacgcctatgaggaaaagatcgagaccgccgtccgggagaccgacggagagaccatcctgtacggcggcgtgcccatcctggcggtgttccactcctgctccgccgggcagacccgctcctccggccaggtgtgggtcagcgacctgccctatctccaggcggtgtcttcgccggagcctgcggacagcatccccaactattacagccgtgtggaattcacggcggaggagttccgggagaaggtcctgacctcctatccggaggcggacctgtccggcgacatcagcggctggctgcaaaacgccgtgacggacaccgccggcagcgtggagtcggtggacgtgggcggcgtgagcatgaagggcagcactttacggagcatcctggggctgcggtcggcctgcttcgagtgggaggcggcggacggcaagctggtgttcttcgtcactggctacggccacggcgtgggtatgagccagtacggcgccaaccagatggccaaggagggagcggactaccggacgatcctcacccactattataccggcgtcaccgtggagccctatactactgccgccatagggtgactctttacaaaaaagccggaaatgtggtaaaatacaatcttccaggggagcttctgcggaagggaggacatgatgagacgaaagctcgcggcactgctgctgtgcctgctgctggtgttccagctgtcgccggtcccgtcgggggcggcggagacggtgtatttcaccgcagtcaacaaaaacgtgctgacgctgtcggacgacaccatgcccttctggtccggcggctatctgtatgtgcccagcactatcttcaccggcgtgggccgggatctgggcgtgtcctactaccccaatattgcccggcagaccgtgttgctgtatgtggacaagacggtatacagctccctggtatttgacctgaacaaggactatgccatcgacaacgagggcaacctgtatttccagaagcccatccagcggggtggcgtgatcttcctgcccatctctctgatcgcccggtgcttcggcctgctctactccaccgtggaggtggaccggggctatctggtttgggtgcgcaatccggatatggatatggaggagcggtactttgccgacgccgccaagtcccggatggactacgagtacaaccagtacctgcggaaccagagtgcggaagaggacatcgcgccggaggaaacggagccctccaccgtcaccgggcagcggatttatctttgtgtggaggccgcggacccgaagcgggtgaagtccctgctggacattctggaccgctatgacgcccacgcggctttctactgtacggaggcgtttctgcgggaaggcggcgacctgctgcggcgaatgaccgccacagggcaggccatcgggctggcggtggacgccgcggcggaccgcccggtgacggaacagctggagacggggaaccgcctgctctcccaggccgccagcgtcaagacccggctggcttggattgaaaacgccggggaggagtctgtctccgcggcggaggcggcgggcttctgcccgctggacccggatctggaccgggcggcgtatcccctcagcagcaccggcgccgccgacacgctgctccagcgggtgaccagccggggcggcgaggtcactgtctggctgggcgacagcgccaacgccgcagggcttgggacgttcctgtctgcggcggaggcggcggacgaccgctgtctggccatgacggagacggtgtcctgacctgccaagatttacaaaatattcaacataccgccccgggagcggatataatagaggatatcaagaatcggctgtgtctgtgaacaggcggacgccgcgggcggcagaaccagcgaagagagacatatcgaaatgggagggagcgccatgggccgcaacatcctggtcgtggaagacgaccgcaatatctgtgatttgatccacatgtacctggtgaaggaggggttcgacgtccgcatcgccggagacggcggcaaggccattgaggagtttcagaagcaggttccggacctgatcctgctggacatcatgctgccggtgatggacggctggtcggtgtgcgccaaaatccgggagaccagcaaggtgcccatcatcatgctgacggccaagggcgaggtgttcgaccgcatccagggcctggagatgggggcggacgactatgtggtgaagccctttgagatgaaggagctcatcgctcggatcaatgcagtcctgcggcggacggagatccccaacgacaccagcaaacggctgacgttcgacaagctggtgattgacctggactcctacgagctgatcgtggatgggaagaaaatcgacacgccccccaaggagctggagctgctgtatcatttggcctccacccccaaccgggtgtacacccggaaccagctgctggatgaggtgtggggctttgactacttcggcgacagccggacagtggatgtccacatcaagcggctgcgggagaagatcgaaaacgtcagcagccagtgggcgctgaaaacggtgtggggcgtggggtacaagttcgagctggcaggcgcccccggggcaaaggagagctgacgtttccggggacgaaggccccggcgccgcgaaagcggcgtcaagcggtccgcaggacccttgaacctgccggaattcatttccggcaggttggtgagatgaaaggggcccccggaggcctgcggcctccggggaaaacagcagccagtgggcgctgaaaacggtgtggggcgtggggtacaagttcgagctggcaggcgcccccggggcaaaggagagctgacaaaaccgcctgaaaagacctttgccttttcaggtggaaaaccgggcagggaggtctcatgaaggtacggatcgcgcgtattgcaaaacggatgcacaacaagttcaggggcctgtactggcggcagatgttcgtcaccgtcggcatggtgctcctgacgctgtttttgctgggagtttcgtttttctccctgagctacaactacgcccggggccaggagaacggggagctggccgcccaggcccaggtggtggggcagctctccgccagctatctggaaaacgggcggtacctggacatggaggagctgcagcacgaggaggacttccagcgtctggcctccttcgctgccacggtgtccgaggtggacttcctgatctgcgacgtggagggccacgtgctgctgtccacggatgcgtctctcagcgggctggtggtgactatgccggaggagatgaccgcagaggtgctggaggagggcatcagctccaggcgcacggacgtggacggcctgtactccaacaagcggttcgtggtgggcgttccggccataagcgaggatacccccgaccccgtcggcatggtctatgccgtgtcctccaccacctcgctggacaccatgtggtccggcttcatcgggctgttcttcatgacggcgttcgtggtgctgatgatctccttcatggcgtcctccatcaccaccatgcggcagatccagcccatccgggagatggccaaggccacccgccgctatgcggagggggacttcgacatccgcatgaacgactacggccgggatgacgagttgggagagctggcggcctccttcaacaacatggcggagaacctgcagcagacggagcgccagcggcgggagttcatcaccaacatctcccatgagctgaagacgcccatgaccaccatcgccggctatacagacggcattctggacggcaccatcccgccggagaacgagcggcagtatctccagatcatctccgacgagagccgccgcctgagccggctggtgcggcggatgctggacgtgagccagctgcaggccatcgaccccctgcgggagggaaagcacttcgacatctgcgagagtatgcgccgggtgctgatctccatggagcggaagatcacagaccggaatctggatgtggaggcggatatccccgaggagcccattctggtgctgggggacaaggacatgattacgcaggtgatttacaacctgctggaaaatgccaccaagttcgcacgggagggctccactctctatctgggcgtcaccaccatcgacggcaaggcccgggtgacggtgcggaacgagggggacaccatcccggcagaggagctgccgctgctgttcgagcggttccacaagagcgacaagtcccgcagcgaggacaaggatggttacggcctggggctgtacatcgtcaagacgattttagagcagcataaggaaaagatcagtgtgaccagcgaggacggcgtgaccgcgttctccttctcactggccacagagtgaggcgtgcatggaggaagaaaagcagttggccggagaggaccgtctctccggagagatcgtagaggtatacagacagccgctgcccggggaggtggtggagcggtacagccgccccctgccgggacggcctgccgcgcccgggcagccccgccggcggcgcaggaccgggctgtggattttcctggcctgcctggcggtggtgctgggtgtggcggcgggctcctggatttggtatctgctgccggccggcagcagtgccgatccctttgagtaccgttacgaccacggctgggaggaggaagaggacgcgtccggggcagttaccatccccacctatccgttcggggagggcgccgtgctggaggtggagacggaccacggccgggagctgacggcccaggagatctaccagcgggtgaacccgtcggtggtgacggtcatggtccagctggacgacagcgtctccgtgggcaccggggtcatcttccgggcggacggttatatcctcaccaattaccacgtgctggcggggggacgggactgcaccgtcgccatggacacgggccggacctatgaggcccagtacgtggccggagacgagcggaacgatctggcggtcctcaaggtggaactgacggggcttcccgccgccaccttcggcgacagcgaccagctggtggtgggcgacaaggtctacgccatcggcaacccgctgggcgtggagctccgcggcacactgacagacggcatcgtctccgccatcaaccgggatgtacaggtggacggccggaccatgacgctggttcagaccaacgcggccctgaactccggcaactccggcggtcccctaatcaacgcctgcggccaggtggtgggcatcaacaccatcaagatgagctctgattactccaatgtggagggtctgggcttcgccattccctccgcctccatccggcggctggtgaacgacctgctgacctatggagaggtccggccggagccctccttcggcgtgacggtgctccagacgggcacccggctggaggacgacatctggggcctgcaggtgctggaggtcacgcccggctccgccgcagacctggcgggcatccgggagggggacttcgtcctcgccgccggcggcaggccggtggaaaccagtcaggagctgctgcgcatccggcggcagctgtatgtgggcgatcaggtgaccatggaaatctggcgggacggagagcggatggaagtgacgctgactctgaatgacccggtggaataaagaacgagggcgcggcctgcaccgcaggccgcgcccttgcttgccggaagtgctcccggcccggggcggaagagcggggtgtctgccctgcggggtagtgtggaaaaaacattgtgaggccgtgggaaaagccctgaaggacttctcccgcggcctgtgtcatgtctgtttcttccggcgctggggccacagcaggctgacaccggagagcagcaggtacacgccgaagggcttgcgcaggaccgccacgtccagattggtggcgatccaggccccggccagggcggcggccacggccagggggacggcgcttttcagggtgggcttgtccagatagccgcccctggcgtggcagaccagggcggaggcggcggtgggcaggaagaacagcagattgatgccctgagcggtccgctggtccacatccagaaagagcgtcatgaccagaagcagcagcgtgccgccgcccacgccccaggccgagaggatgctggcccccaggccgcagagaaagggaatgatccagtccgtcacagcagatacttcacccccgcgtagaacagaaaaccggcgaagagccacttgagccacttgacggagactctgccgtacagcttgccgccgatccagccgcccaccaggccgcccgccagatagggcagcgccgtcaggagggagagctcccccgaaacaggtacacggcggcggacaccagacacaccggaaagatgacgcccacgcaggtggcgtacagcttccgctgggagaggctgccccagcgggagaggatgggcaggaagaccatgccgcccccgccgccgaagaggccgttggccagccccgccgcagtgccggcgatccgcgccggccagcgatgttccatgtgatcccgcctttcctcagggatgtaagcggcgggcttcgggagccggagaggacgcccgaagcccgtcggacctggttatttcatctggaagctctggcagtcggtgcactccaccttggtggggttggtctcatgggtgcccacagtgatggtgttcagaccgcagtagttctggtcctggcagtggtgggcgcagttggtgaccgtgcacttgatgctctggttgggggtgcaggcgcagccgttgttggtattcgtcataacaaaagatcctcctgcgtgaaaaagtgtgtggctttcgccgccctctagtgtgcgcaggcgcggccgggttatgtacggtccggcctgggtaaaaatttgtcacaggcgggcgtgtccggcgtccggtttttggcgcggggcgcggcgacgcaatggccgtcatggatctctacaaaacggcggcgcgttcggatgtagtgctggtagtagtgtgcgcagtcggaacaggtgaacgaatccatatagggtgtctcctttctgattgagttcttagattgtactgcaagttgatgaaatcatcagaatgcattgtgacttcaaaatgatatcgtgatttcggttttttgtgcaaaagtattttataacaaagaaaatgcagaatatatgttaacttttatcacacaaaatatgtgataaaaattttatataaaaaggtgggccgctctatctgagcggcccacctttttcgatttggatgcctcgcagagtttcgcgccgcgcacggcgcgaaatcaaatgaaatcgtttttccggcggcgtgtacgtcggaaaaacactccgcgcggagcgagcgtcgaattgcccgccgcaggcgggcaaccgaggcgcagagcggagcgaatctcccttcacctgaaaaggcgcagccttttcaggtgatttatacgcctaagatccaagttgcgaatcggaagtagatcagcagagacagcgcgtccacgatggtgctgatgaagggcgaggccatcaccgccgggtcgaacccgatcttctccgccaaaatgggcagggaggcgcccaccagcttggcgcaggccaccgtgcccaccagggtgcagcacaccaccgccgccacggcaggcgtcacggtgggattggccagcagccagcagtccaccaccatcatcttcacaaagttggccgccgccaggcacacgccgcagatcagcgccacgcggcactccttccacaccacgcgcagcaggtcgctgaatcgaacctcccccagcgacagggcacggatcaccgccgtggaggcctgggtgccgctgttgccgccggtgccggagagcatggggatgtaggaggtcagaatgggcaccgccgccagggaattctcaaagtgggtcaggatcatcccagtgaaagtggcggacagcatcagcatcatcagccagggggtccgggcccgccaggtctcaaacacgccggtcttgagatacggcttgtcgcccggcaggatggcggccatcttctcgatgtcctcggtgacctcttcctgcaggacgtccatggcgtcgtccacggtgacgatgcccacaaggcggttctccgtgtccacaatgggcagggccaggaagtcgtatttgttcagggtttgggccacatcctcctggtcgtccagggtgttggcggagatcacatgggtatccatgatgtcccccaccacgtcgtcctcctccgacagcaggatggtccggatggagagataccccagcaggtggcggccctcgtcgatgacgtagcagatgttgatggtctccttgtccgggccggtgcggcgaatgcgcttcagggcgtcctccacggtcatggtggccttcaggtccacgtactccgtggtcatgatgctgccggcgcagtcgtcggggtatttcaggatttcgttgatgctcttgcggacgtccgggtccgcgtggcgcaggatgcgcttgaccacgttggcgggcatctcctccacgatgtctaccgcgtcgtccaggtacagctcgtccagcacttccttcagctccgtgttggaaaagctctggatgagcacctcctgctcctcagaatccagctccacgaacacctcggccgcctgctccttgggcagcaggcggaacaccatgggcaccttgtcgtccagttccatgaacaggcccgcgatgtcctgggcctccagaggcagcagaaggtcgcgcagctcggcgtagcgttttcgggagatcagatcctcgatcttttccagcagctcgtcccgctgctcttcctgctctaacatgcgcgtcctcctctctgtgggactggtggttgagaaaacaaaaaaacccggccgctcctgtccggtgcagtcggaaatttccgtgtcaaaacagggacgccgcatcagcggaccctgcggccgttcaagctttagcctcacaaggcggtgaaatcacgttagatgataccttcgtgttcgatagcacctgttcaaaccctctcatgatgtctccatcactccgcggcagcgatccgtatccctgtggtagccttacctaccggacggtatgcagttttgccgaaactctttcttcatattatgccaatttctgccccctgtcaaggcggcagaaaaaaactccccacaattttacaggcccctcaaataccgctgcactccattttacaaatgggaatcccgcttgtgatagaggacggcctgtggtataataagatgttccaaatctgtgcccgaaacggggcgtttcagcgagaggaggccctccatgggcatacacgacggacaccgggagaagatgcgccggcggtttctggagacggggctggagggctttgcggaccacgaggccctggagctgctgctgtactacgccatcccccggcgggacaccaaccccatcgcccacgccctgatggagcggtacgactccctctccggcgtgctgaacgccccggtggaggatctggagaaggtggagggcatcggggagagcgcggccatcctgctgtccctggtctcccggctcagccggaaggcccgcatagcggacgcgtcccaggagaccatcctcaactcctccgagcgggcgggggcctatctgctggagcgatttgccggcgagcggcgggaactggtcttcctgctgtgcctggaccgcaagggcaggctcctggcctgcaagcggctggcggagggggacgtggccagcgcggacctgaacatccgcaaggtggtggagatggcgctgctgacctccgccagcgcggtgatcctggcccacaaccaccccagcggcgtggcggtgccctcctccagcgacgaggccgccacccgccaggtggcggaggccctgcggaccatcggcgtccgcctggtggaccatatcgtggtggcggaccgggacttcgtctccatggcggacagcggcgacctgctggggtaaagagggagcaggcgccccctttagaacccccaccaccagtctgtggactggcgaacgcgcccaaggcgcttgggtcggggtattttgccacgtacacgccgcggcgaaaatgacttcaagttcttccttcgccgctggcgaacgaactggggaaaaccggaggggttcccctagtccccccttccttttttgtcccttcgcttttttcaaggcatggttcctttgataaaagtcgaacaaatgttgcaaaaagatgacgggtgtgataggatggccgtggctgaaaatctgtttgatgggtggagggaatgccgctatgccgaaatttgaagtcgtatctgaatacaagccctccggggaaccccgcaaaagcggcacttttgcggggaccccgtgattcggatggaccgggcaggcaaagcccgcccagtccaaggttttgactgcgccaaaacgcttgtgcgccgcggccgcggcgccggccctttgggccggggctggtccccggagaccatagcaagaaaaaattgcggagaagagctatgccgaaatttgaagtcgtatctgaatatcaaccctccggggaccagccgcaggccattgccgcgctggcggagggcatcgagaacgggctgaaggagcaggtgctgctgggcgttaccggatccggcaagacctttaccatggccaaggtcatcgagcaggtgcagcggcccacgctggtgctggcccacaacaagaccctggccgcccagctgtgcgcggagttcaaggagttcttccccaacaacgcggtggagtacttcgtctcctactacgactactaccagccagaggcgtatatcccccatacggacacctatatcgccaaggatgcctccaccaacgacgagatcgaccggctgcggctcagtgccacctgtgccctgctggagcggcgggacgtgatcgtagtatcctccgtgtcctgcatctacggcttgggcgagccggacgattttgccaacctggtggtgtccctccgggtgggggccgagtgggaccgggatgagctgctgcgccgcctggtggagatccgctacgagcgcaacgacatcgcctttgagcggaacatgttccgggtccggggggacacggtggagatctaccccgcctactaccgggaccacgccatccgggtggagttcttcggggacgagatcgaccggatcagcgacttcaacccggtcaccggcagcgtgaaccgggtgctgaaccacgtggccatctacccagccagccactatgtcaccaccaaggacaagatggacaaagccattctggagatccgccaggagctggaggatcaggtgaaatacttcaccgacaacaaccagctggtggaggcccagcggctccgtcagcggacggagtacgacatggagatgatggcggagctgggctactgctccggcatcgagaactactcccgcatcatctccgaccggcccgccggctccgcccccatgaccctgctggacttcttcccggacgacttcctgctgttcgtggacgagagccacgtgaccctgccccaggtccgggccatgtacaacggcgatcatgcccggaaggactccctggtgaagtacggcttccgcctgccctgtgcgtacgacaaccgaccgttgaagttcgaggagttcgaggagcggatcggccaggcggtgtttgtctcggcaacgcccggcccctatgagcgggagcgggcggaccaggtggtggagcaggtgatccgccccacgggcctgctggaccccagggtggaggtccggcctgtcaccggccagatcgacgacctgatggacgagatccgtgcaagagccgcccgggacgagcgggtactggtgaccaccctcaccaagaagatggcggaggacctgacggagtacctgaaaaacgccggcatccgggtacggtacatgcactccgatgtccagaccatcgagcgcatggagatcatccgcagcctgcggctgggagagttcgacgtgctggtgggcatcaacctcctgcgggaggggctggacctgccggaggtcagcctggtggcgatcctggacgcggacaaggagggcttcctccggtccgagaccagcctgatccagaccatcggccgggcggcccgaaacgcagacggcctcgttatcatgtacgccgacgagatcacgccctccatgcgggcggccatcgacgagacggaacgccgccgctccatccaggacgcctataatcaggagcacggcattgtgcccaagaccatcatcaagggcgtccgggagattttggagatctccaagaccgcggaggaggacaccctccgggcccacaagaagcgcaagctgacggagcaggagcgggcggcggagatcgccaagctggagaaggagatgcgcgaggccagcaagatgctggaattcgagtacgccgcggtgctgcgtgaccggatcatcgagctgcgggggagaagtgacctccgcaaagagcaggggtgtatggcgtactcgaatcgccgggagtccggcgtacaagcgttttggcggaggcaaaaccttgaaccgggcagaattcacttctgaccggttggtaaaatgaaaagggctcccgcacggcggagccgtgtgggaatgtacgccgcagtgctgcgtgaccggattatcgagctgcggggggagaagtgacctccgcaaagagcaggggtgtatggcgtactcgaatcgccgggagtccggcgtacaagcgttttgacggaggcaaaaccttgaagcgggcagaattcacttctggtcggttggtaaaatgaaaagggctcccgcacggcggagccgtgtgggaatgtacgccgcggtgctgcgtgaccggatcatcgagctgcggggggagaagtaaatgcactacgaatggctggacgcatacctgctgtcgtttcccggcgtggagaaggactatcagccggtgtggcagtggttccgctataaggtccggggcaggctgtttgccgctgtctgttcgccggggccggagtacaaaatttacggcggccacgatctggtgaatctgaaatgcggggcggcggagggcgagctgctgcgggcccggtatccggacatcctgccgggattttattcggataagcggacctggatttcctgcctgctggacggagaactgccggaggaggtcctgcgggacctgtgcggccggtcatacgccctggcggtggagaagctgcccaaatacgtccggcgggagctggcggagcagcccgcggagagctgaggtgtttgcaatggcgaagaaaaaagaggaaaagaccaatgtgatgcggatcctggaccagagaaagatcccctataccgcccggttttatgaggacagccaggggccggagggcacccgggagtacggcgtccacgtggcggaggctctggggcaggacccagccagaggcttcaagaccctggtagcccggggggcgtccaagggcatctacgtgttcgaggtgccggcgccggagaacctggatctgaagaaggccgccagggcggtgggggagaagtccatcgagctgctgcacgtggcggagatcaacgccgttaccggctacatccggggcggctgttccccggtggggatgaagaagcagtatcccaccgtgttccaccggacggcgctggactacgaaaccgtctatatctccgccgggaagatcggcgcccaggtggagctggcgccccgggcgctgctagacctgctgggggcctccacggcggacattgtcgtggaccagggataggcccaggtggagtcccagggtgaaggcgtcggtggaccactggaggtagcgggccagaaaggcgtcctgaaggcacaggcgggcgtccccggagagggagaggctgtccgccagctgatccacggatttggaatcgaaggggtctgctttctgcagaatgtcggcggcgtagccgtcgaagaggcggagatagatgggattcattggatcaccttcaaacaacatttaatgatgtattgatgatacatcattaaatgatatatgtcaaggagaactccatggaaacactaaaaatatttggagaaagactgcgtgccctgcgggatgaacggcatctgcggcaggcggatatggcagaagtgcttcaaattacccttgtccattatcagagaatggaatatggaaaggtcaatgtcccatcgctgacgctttgctttcttgcggattacttcagcgtcaccacggattatctgctggggcgcagcgacgcgcgggggtaaatccgttccgtgcacccgtaggggccaccgccctcggcggcccgatggtatggccgcccctggagcgtgtaagggaggttacaaaccgcccgtggaaatttgggccgccgtccggcggccacggggattctgctcccgcagggggcttgtccagccgggatgcaccccccgttttcttttccgacttgcggaaaagaaaacgggccgtgcacggtccaaaagaaaaggccgcttggacgcgctccggtgcagtggccctccgcgcgcaacgggggtcggcgtatcggtgcctgctccgatttggactggccttcgggcacgctatgctcttctgcgattcctgttgctgccgtcccgtggcggatggcgccgacctcgtcggggtggttgtcgcatggagctgcttctcttttcgctaccgctcacgctcccgcgaagaatccggcagcgcgtagcgcagcggaacgcgcggaaagagaagcagaccaaatgcgtccttgcaccccgttgacctttgcacccgcgccgcgggaatccgcgttcaagcctgtaccgcaccccgccgcgcccgtcgggaggtcatcgcaaacccgcaggcaccatctctcgtcaactcccgtacagcaactttgcacggacgtgcaaagttgcgaccaaaagcgttttttctcttacaccgggcgcggcgcgttctctttttggcgctgacaaaaagagaatggggggcgcatcccccgtggaaacggccccctggcgggagccagtctccccgggtggttgaaaagcgcctctacacctccgccggaggcatttccggcactgaaaagagaaacctctcctgaaaggagtcaatcatacacattatgcaggacaagatcatcgtcaaaggcgcccgcgccaacaatctgaagaatatcgacgtcaccatcccccgggacaagctggtggtcatgacgggcctctccggctccggcaagtcctccctggccttcgacaccatctacgccgagggccagagaaggtatgtggagtccctcagctcctatgcccggatgttcctgggccagatggacaagcccgatgtggactatatcgagggtctcagccccgccatctccattgaccagaagaccaccagcaagaacccccggtccaccgtgggcacggtgacggagatctacgactacctccgcctgctgtgggcccgggtgggcaccccccactgccccaagtgcggcaaggagattcgccagcagaccattgaccagatcatcgatcaggtcctctctctgccggagggcacccgcatccaggtgatggcccccgtcatccggggcaagaagggtgagcacgccaagatctttgaggacgccaagcggtccggctacgtccgggcccgggtggacgggaatctgtacgagctggacgaggagatcaagctggagaagaacaagaagcacaccatcgagattgtggtggaccggctcatcatccgtccggatatccagcagcggctgacggacagcgtggagaccgcctccggcctcaccggcgggctggtggtcgtcaacctcctgcgggaggagcgggatctgacattctcccagaattatgcctgcgaggactgcggcatctccatcgaggagctgacgccccggatgttctccttcaacaaccccttcggtgcctgtcccacctgtacgggtctgggcagccagctgaaggtggatccggaactgatcgtgccggacaagtccctctccatcctggagggggccatccaggccagcggctggaacaacatccgggggacggcatctcccggatgtacttcgacgccctggcgaagaaataccacttctccctcaccgacccctgggagaccctgccggaggacgtgcggagcatcatcctctacggcaccggcggggagaagctggagctccactacgaccagccccggggcaagggcgtgctgtatcagccctttgagggcatctgcaacaacgtggagcgccgctacaaggagacccagtccgatgccagcaagcgggagctggaggagctgatggccgagtgcccctgtcccacctgtaagggaaagcggctgaagaaggagtccctggcggtgaccgtgggggacaaggacatcgacgccctgacccggatgtccgtggtggacgagctccaatgggtggaccggctggagctgacgcaccagcagcacctgatcgcagaccggatcctgaaggagatcaagtcccggctggggttcctccagtccgtgggcctgggctatctgaccctcagccgcagcgcggggaccctctccggcggcgagagccagcggatccgcctggccacccagatcggctccagcctgatgggggtgctgtatatcctggacgagccctccatcggtctgcaccagcgggacaacgacaagttgctggcgacgctgcagaacctgcgggacctgggcaacaccctgctggtggtggagcacgacgaggacaccatgcgggcggcggactacctgatcgacatcggtcccggcgccggcatccacggcggcgaggtggtggccgccggtacaccggaggaggtcatggccaaccccaacagcctgacgggtcagtatctctccggcaagaagaggatccccgtgccggagacccggcggccgggcaacggcaagagcctgaaggtcatcggcgcggcggagaacaacctgcggcacatcgacgtggagttccccctggggacctttaccgtggttaccggcgtgtccggcagcggcaagagctccttggtgaatgagatcctgttcaagaagctgggcgtggagctgaaccggatgaaggtccaccccggcaggtgcgaccggatcgagggaatcgagtatctggacaaggtggtggacatcgaccagagccccatcggccggacaccccggtccaaccccgccacctacaccggcctcttcaatgacatccgggacctgttcgcctccactcaggaggccaagagccggggctacggcccggggcggttcagcttcaacgtccggggcggccggtgcgaggcctgctccggcgacggtgtgctgaagatcgagatgcacttcctgccggacatctttgtgccctgcgaggtgtgcaagggcaggcggtacaaccgggagaccctggaggtccgctacaagggcaagaacattgccgatgtgctggagatgaccgtggatgaggcggtggagttcttcgcacctctgcccagaatccgcaacaagctccagaccctgtgcgacgtgggcctggggtatgtgaagctgggccagccctccacggagctctccggcggtgaggcccagcgggtgaagctggctacggagctcagcaaaatcgccaccggcaagaccatctatatcctggacgagcccaccaccggcctccacaccgacgatgtgcgcaagctcctggaggtgctccagcggctggtggacagcggcaacaccgtggtggtcatcgagcacaatctggacgttatcaaatgtgccgaccacctgatcgacctgggtcccgaggggggagacggcggcggcaccatcgtctgcacgggcacgccggaggaagtggctgcctgccggtcgagcttcacaggtcagtatctgaaaaaggtgctggaaaagtaagccggggcagacgatccccttggagcccccgccggagcccagcgaagcgggtccggtggggaaaggacgggccgcggaggcagcaagccgaaggccggggcgcgggatccggagcaggcgaggacgcgcacaggcacgccggaggaggtggccgcctgccggtcgagcttcacgggctggtacctgaaaaagctgctggagcggtaagaccgcgcaaaaagggcctccgctgtatgcggaggcccttgtctatggggcgtcaattccagaagttcggaaacagcagctccgagatcaccttcaccagcagcaggagcagcacgaccaccaccgcaggccggacgattttgctgccgttcctgatggccaggccggcgcccagatagtgtcccaggatggaggccagagcggccgccagccccacacccagaacgacggtccccgccatcagggcggagcacacaccgccgatgttggaggccaggttgatgacctttaccccgccggccgcgtggcgggtgtccatcttgcccaagtggatgaacaccagcatcagaaaggtgccggtgccggggccgtagtagccgtcatacgtcccgatgagcagcgcggcggcccagacgatggccgcctgccgccggggcgggatgggggccggctcctccggccacattttggtccgcagggtgaagaaggccaccaccggcagcaccgccagcagcagatacttcagcaccacatccggcgtgtgaagctgcagctgggtcccgcagacggagcctgccaccgccagcccggcggcaggcaggaacagccgccagtgaacgtacccctggtggatgaagcgggcggtggaaaacgcggtgccgatgcaggaggagagcttattggtgcccaaaacaaagtgggtgggcaggccggagaaggccatcaggtatacagggacggagataatgccgccgcccccggcgatggcgtccataaagccggccagaaagacgccgccgcagatcagaaggaccacccacagggggaagccgtccagcgtggtttccgtgaagagagtggggaccgaggctgacatatatgcacctcccggagtaaattcgacaaaatctctatcagtataccagctccataggcccctggcaagagcagaagcgccgcaattttgctgaaattcccgcatctccccgaagaaatgccgccggaacggttgtttttccggcgggcgtgtgatactgtgaaacaggcggggcgggatcgcccgcgaaaatgctcaaagaaagttgaggatcacctatgtcaaacatcaaaaacgtcgccatgattaccgtgtgcggacggcccaacgtgggcaagtccagcctgaccaacgccctggtgggggaaaaggtggccatcgtctccaacaaggcacagaccacccggaaccgcatctacggcgtggtgaaccgggaggacacccagtatatcctgctggacacgcccggcctccacaagcccaagtccgccctgggggactacatggtgaaggtcgtcacctccagcctctccgacgtggactgcgccctgctgctagtggagcccatcccccatgtgggcggcccggagcaggcactcatcgaccggatccgggaggaggagatcccctgcatcctctgcgtcaacaagattgacactgtggaaccggcggagctgctgccggtgatcgccgcttacaaccaggcatgggacggctttgacgcgatcatccccatctccgcccacaccggcagcggcctgaaggatctgatgaaggaactgcggaagtatgcccaggaaggccctcagctgttcccggacgggatgacgacggaccagccggagcggcaggtgatgggggaaatcctgcgggagaagctgctgctgtgcctggacaaggagatcccccacggcacggcggtggagatcacgaagttctctgagcgggacagcggcgtcatcgacgtggacgccaccatctactgtgagaaggccagccacaaggggatcattatcggcaagcagggggccatgctgaaaaagatcagttccctggcccggcaggatatggagaagttcatgggcaccaaggtgtatctggagacctgggtgaaggtcaaggagaactggcgggacaacgtgaactacgtgcggagcttcgggtaccgggacgaataaggaggaagcgtgcggtctccggtattccgcaggctgccgtgcggggagtgagaatatgagactggtattgagcgacacggcactgccaaccggactgccggtccgggaggactggcactatgtggacctgagccagctgaaaatcgcggactgtatgggctgcttcagctgctgggtcagaacgccggggcggtgcgtgatccgggacgacgctgtaggcgtatatcccctgattgcccacagcgaccatgtgatctatgtcagccgtctcttctgcgggtcctatgacgtaccgatgaagaccatgctggagcgggccattcccatccagcaggcgtttattcggatacaccacggagagacgcaccatatacagcgggcggtggcggagaaagacgcggtgattctggcctatggagataccggagacgaggagcaggcgctcttccgtctgctggcggcccgcaacgcccataatatgctgtttcggagctggagtgtccgcttccttcgggaagaggagctggccggggccattagggaggaggtacgcgcatgggaaagctcctgatcgtcaatgggagtccccgggcgccccgttccaactcccggaggtatatcgaacagtttcttccgtgttggggagagacggcggaccagtataccgcgctgaggggtggaccgctctccccagaggactgtacggatctgctgctggtgttccccctgtacgcagacggcataccggcggtgctgatgaggaccctgaaggaactcgcagtatggaggggaacggcccgccccaggatccacgtactggtgaactgcggctttctggagccggagcagacccggcctgcggtagaaatggtgcgctttttctgcaaacgatatggatttccctgggggatggcgctgcagatcggctcgggagaggcgatcttgaatacgcctttttcctttctggtgcggcggggcctgcgccgcctggccgctggtatgcgggcgggacggagcgaggtgctgtcggtgcggatgccgctgaacaggcggatgttcgtctgggcctccggccggtactggactgattacggcgcgaaaaacaacatcaccgccggagagatgcggaccatggagatcgagggaggctagagatttccagccataaaaatccgacaacattcgcagactactcctgggaggaggtctgcggaatggacacacaaaggctttgggagtgcttctgcctcaccggcgaaccgctggtgtacctgctgtatcaggccgctctggaccaggagtccggcggcgggatcagcgcatagaacggagggcggacgctctccgtacataaggagggagcgcgttggccgagcgggcctacatcgtgacaaagggcgtggtcctgcgggagacggagacgaaagaggcggataagatcctgacgctgctgacagcggaccggggcaagatctccgtcatcgcccggggcgtccggcggaagagctgcaagtacgccgcctgcgcccagcagatggtctattcggagtggaccctctatcagaagggcgagtggtactacgccaatgaaggagccacggcggagctgttcaacggcctgcggacgaatctggaggcgctggccctgggctgctacttcgcggagctgacagagaccgtcacggcgccggaggtccctgccggggcactgctgccccatctgctgaacgggctgtacgccctctccgctttacagaagccgccggcgctggtgaagcccgcctttgagatcaaactgctgtgcttggcgggatatgaacctttggcggacagctgcgcctactgcggccggccggacccggagcagcccctgctggacgtggtacagggcatcctgcggtgccggagctgcggcgcgaaggagagtgccctctccatgcccctgtgcccggattccctggcggccctgcggcatatcgtgtacggggaccccaagcggctctactcgttccggctgacaggcccggcgctggagcgactctccgcggcggcggaggctttcgtggccgcccagctggagcggggattccggacgctggaattttacaagagcctccagccgccggaagagttgtcgaaataagatacattttgtatttcttttgctgatttatacgaaacggagcggaatatgacagaatttgtcctcggctcctaccggctggaggtggacgtggaggccacccgggcctggtatggccgttacggtaacgctaccgggggctgcggctgcgcctactgccgaaactatgctgccgcagttggggtcctgccgccagaagcagcagcgtttctggaacccctggggcttaacctccgcaggcccggagatattggcgagtatggtccccgccagggcgggcggtggtatatgcccatgtggcacattgcaggccgcctgctggaagcgggggagggagagctgcccgttgcccccggcgtcaccgccgggttcgccacagatatgggaccgttcctccggaacttcccggagccctgcttccagtgctggctttccatgaccctgccctgggtgctggaggaaccggcagatgaagcagctgacgacagggacgatgaagtgaaaacccttgacaggagaaccgaaccatgagtgacctatttgacaaatccatccgcaccctggagctgccccgggtgctggagctgctgagcgagcaggctgtcagcgccgaggccaagcagcgggccctgcgcctccggccggagacggagccggaggaggtgctgcgcctgctggaccagacggacgcggcccgaaatctcatcggcctgcggggcagtccgtcgttttccggcgtgaagccggtggcggaggccctggaccgggcggaccggggcggcgccctgaacactcgggagctgctgaccatcgcggatctgctgaccgccgcccgccgggccaaggagtacttcaacgacgaggcggcggagaaaaccgccatcgaccacctgttcctctccctccacggcaaccgctttctggaggagaagatcaagcgggccatcccggacgaggacaccatcgccgacgccgccagcacggagctggcggacatccgccgccacatgcgggcggcccaggccaagagccgccagatccttcaaaagatcatctcctcccccagctatgggaaaattttgcaggagaccatcatcacccagcgggacggccgcttcgtggtgccggtgaaggcggagcacaagggcgacctgccgggactggtccacgacatctcctccaccggagccacgctgttcgtggagcctatgggggtggtccaggctaacaacgagtatattgagctgcaggccaaggagcagaaggagatcgaccgcatcctggcggagttctccgccgaggctgccgcccaccgggaggacatccagtgggactacgacaccctggtccacctggacctgatcttcgcccggggccagctgagctacaagatgaacgccgtgcggccggaggtccgccgggacggcgctatccatctgcgcaaggcccgccaccccctgctggaccccaagacggcggtgcccatcgacatcgagctgggggacacctttgacaccttggtcatcaccggtcccaacaccggcggcaagaccgtgaccctcaagaccctgggcctgctgacgctgatgacccagtgcggcctccacatcccggcggcggaccggagcgccgtgtccgtctatgagcgggtgctggcggacatcggcgacgagcagagcatcgagcagagcctgtctaccttctctgcccacatggtgaacatcgtggagattttaaaagaggcggatcggcacagcctggtgctgtttgacgagctgggggccggcacggacccggtggagggcgcggccctggccatcgccgtcatccagcacgtgcggcggctgggggccaaggtggccgccaccacccactatgcggagctgaagaccttcgccatgactacggcaggggtggagaacgcctcctgcgagttcgacgtggagacgctggcgcccacctaccggctgctgatcggcattcccggcaaatccaacgcctttgccatctcccggcggctggggctgccggaggacgtcattgccgccgcccaggggcagatgagcggcgagagcgtccggttcgaggacatcctgacccagctggaggagaagcgccaggccctggagaagcgggagcaggaggcggaccgcctgctgcgccagcgggaagaggacgccaggcgcgcccgggagttccgggagcagatggagcgggccaaggacaacgcccggagccggggcgaggcggaggccaagcgcatcctccgggacgcccggacggcggcggaccaggtgttccaggagctcagcgagatgcggaaggcccaggccaaggccgaacggatgctgaacgaaaatgaggcccgtgcggccctccgccgcacgctgaacgaggcggaggaggccgtgtcccgccgcgacgcccggcaggagcccatccccaagcccagccgccccatccgggcgggggatctggtggagatccccggtgtcaaaacgccggcggaggtagtgtccgtgggcaaggacggcaccttgcagctgaaagccggtattttgaagatgaaagccaaggtagacgaagtgcgtcttatcgaggatgacgagcgggccgccaggaagaagacgccctctgtcaccattcgccagaacgccgaccgcgccctgcgggcttctgccgcccgggaactggacatccgagggatggagacactggaggcggagagcgtggtggaaaacttcatttccgccgccgtcatgggcaaactggagaccgtaaccatcatccacggcaagggcaccggggccttgcggaaggccgtccacgacatcctccgccggaataaggctgtgaagagcttccgcctgggcgtctacggcgagggagagagcggcgtcaccgtggtgacgctgaagtgagccggagcctgtcgccgcggtgcggcatcaggcgtcctgcgcggcgggaccttggagtgtgagggctctgcctgaccgccccaattaaatgcgggattcctgtggggtgctccccatgggggcggcgagcccggcaacactgaaatgagggggttgacatggcactgacctttcgatttgcacaggagaccgacacgctcctgatcctgcaattcatccgggagctggccgactacgagcacctgctggaccaggtggtggccgatgaggccaccctccgggaccagctgtttgaaaagcgccgagccgaggtcctctttgccctggaggacgggacagaggtgggcttcgccctgttttttcaaaacttctccaccttcctgggtcgggcgggcctgtatctggaggacctgtatgtccggccggagcaccggggaaagggatatggcaaggctttcttccggcggctggcggccatcgccgcggagcgggactgcggccgcctggagtggtggtgcctggactggaacacccccagcatcggcttctacaagtccctgggggcggagaccatggaggactggaccgtttaccgccttaccggaccggcattgcagaggctggcagaaccggaatctccggttgcggaaaccgatgagatttgatatactggagtcacactaaaacacacattctggaaattgcacaatgaggtgattttatgcaagagcttgcaaagcagttccacattgcctgtgctcagggggatatcggccgctactgcatcctgcccggtgacccgggccgggtcccggccatcgccgccctgtttgacgacgccaagcagatcgcgtataaccgggagttcaacgtctggaccggcaccctgctgggggagaaggtcaccgcctgctccaccggcatcggcggtccctccgcttccatcgctatggaggagctccacaaatgcggtgccgacacgttcatccgcaccggcacctgcggcggtatcgatctgaacgtccagtccggcgacgtggtggtagccaccggcgccatccggtatgagcacaccagccgggagtacgcccccattgagttcccggcggtggcggacttccaggtgacaaacgccctggtggaggccaccaagaagctgggcttccccctgcacaccggcatcgtccagtgcaaggacagcttttacggccagcacgaccccgctgcctcgcccgtgtactacgagctgcagcagaagtgggaatcctggaagcggctgggcgtcaaggccagtgagatggagtccgccgccctgttcgtggtggcggcggctctgggctgccggtgcggctcctgcttccatgtggtgtggaaccaggaacgggaggccgccggcctggaccagaagatgagtgaggacacatcctcctccgtgaaggtgtctgtggaggccctgaagctgctgattgaggcggaccgcaaggcgggccggtaattggctgcgtttttgaaaaaagatgcccggaaatttccgggcatcttttttgattccccattgacaagtttacttggtatatggtatgctctgcttgtaaagaaaacttggtaaaataaaaagtaaactatgcaaaatggttcggcatggatcgggaggagatcctgcggcacagccgggcggctggcgactggttctgatcctgagtctgctgctggcgggagccgcgttgttgaatctggccgtttatgtacggggcgtactgggatgagaggcaggccctatggcttggcaaagaaagaaaagggagaacgctatggaaaaacaggaaattctggagaagagccggcgggagaaccagaagggtgacgaacgggagcggaccatccgcatggagggggagtccttcagcctgctcttcgtgtttttgatgggcctgattctgctgacctggaagcgggtccatgggctgccgcatgaggatgtgctgaccatgttctggacggcctgcgtggccaaccgggtctaccggctggcccggcggcggaatacctccgacatcgtgacgctgctgatctctcttgcgtttttgatctggaatctggtaaaattctttcaaatggcctgagaggaggtagcgcatggaccgggatgagattttgaaaaaggctcaggcgggggcgattggaatggacgagcgggagcagcaggtactggggctgtcctttggtatcggcgggatcctgatggtactgctgtgtgtcattctcgccattatacggctggtgaacgggcaggatgcctatgactacacggccatcgtgtttctgtatctggcgggcgtagagctgcatttgtattggaggacccggcggcggggcttggcgttgctggcggcggcctgcggcctggtgttcgcgggcaacctggccatgttcctgctggggtgagcgccatggacgatcagctgatcctgaaaaaccggctgaaggtggcccgggcggagaaggggctgtcccagacccagctggcggagctggtgggcgtgtcccgcaacaccatcagctccattgagacggggcagttcaatcccaccgccaagctggcgctgattctctgcatcgccttggacaagaagttcgaggaactgttctattttgagtgagaaattaggagtttgggtgtccagcggcgctgaccggggcaaatcatcctgcctgcggcggagcacaatccttccgcatccctaactgacggccggtcgttccggagagaggagagatctctgtggagaaggagaaaattctgcaaagataccgccaagagggcgtggacgagggccgggaggaggtcaaccgccggggagacgacgcgggcttttacgccatgtgtgtcctggcgctgctgttgatgatctaccaggcgtttaccggacaggtatttggagacgtggcggcgatgctgttcgtgttttgctccgtgggggcctttgcccggtaccggactgaccgggaccggtccgctctgggcatgggcatttttaccggcgctctgtgcctgggatgcctgggatggtatctgtggcacacgctgtaaaaaagacaggcggcgctggaaagcgccgcctgcttgcttaccgcttccgcaccgggtagcagacctcggtgacaaattcttctgggttccgggtctcgtggggactgacgtggtagatgttgaagaacagtccgtcaaaggcatagccgttgtcctctacccaggatgccaccgcctgattcacctcgccgatctggcggtaggggccctggaaggtggcggaggccactgtcaccggcgggatggttttgaatttgacgtgctcggtgtcagggtatgtgcccttcaccgtcttttggatctccacatccacatctgcctctttgtactccccgtcgtggtagacgctgatgcacagggccgggtcgccgtcctggatgtggagaagggcggtctccctcacaaagatgtgccacaggtctccctcccggtcgtagcagggaaggatctggcggacgctggctacctgccgctccggcagggtcttgatggtgacatcgtagttcatctgtttttcatcctttctcagccgttcgatggttgtgtccagaagccgcagccggtccaatgcctcctgaatggaggcctccaccgctgcccgctgggccagcaggcgcgtctccatggcggtccggtcctcccagcaggccagcagcgcggccgtctctgccagggagaaccccaggccccgcagggcggtgatccggttggcggtcatcagctgggccgccgcgtaccggcggtagccggtccagggatcggtctcctccggcaccagcaggccgatctcgtcgtagtggcgcagcatccggatgctgattctggacagctttgaaaattctccgattttgaacataggatccctccgcatatatgcgttttcttgagctcactgctatggtatgccctgccactgtgtgagagtcaagagaattttttcaaagtcgcgatgagagaaaaaacgttccggccgcagaagcggccggaacggcggtgggctcagtcgtcggtgcggatgccccgttcaatatcccggatattgtagggggaggtttggtagacgaagtaattcagccagttggagtacagcaggtgggcgcaggagcgccaggtcaccgcaggcttgcggctggggtcatcgccggggaagtagttcttggggacccggatgtccgctccggcggtcaggtcccgtatgtactcattccgcagggtgtcccggtcatactccgcgtggcccatgaggaagatctgccggccctggtcggtcttgacggcgtagaccccggcctccggggaggaggcaagtatcttcagctccgggattgcctcgatgtcctcccgcagcactgtggtgtgccgggagtggggcacccagaactcgtcgtcaaagccccggaagaggatgaagttgggatcctccaccgtgtggcggaacacgccgaagagtttctccggcagctgccgcttggggatgccgtagtggtagtacagccccgcctgagcgccccagcagatgtgaagggtggagtggacgtgcgtcttggaccactccatgatctcgcacagctccggccagtagtccacctcctcaaagggaaggttctccaccggcgcgccggtgatgaccaggccgtcaaaggtccggtcccgcacctcgtcaaaggatttgtagaaggccagcatgtgggcctgggaggtgttcttggacacgtggccgctgggggcgatcaactccagctcgatctggatgggggtgttgcccaacacccgggccagctgggtctcggtctcgatcttggtgggcatcaggttcagcagcaggatctgcagggggcggatatcctgggtgatggcccgggtctccgtcatgacaaagatgttctccgacgtcagaacggaggtggcgggcagctggttggggattttgatgggcatctcacttcacctggtccagcgcctgggcgatgtcgccgatcagatcctgcttgctctccaggccgcagctcatccgcaccaggcccgcgggaatgccggcggcggcaagctgctcgtcagtcatctgccggtgggtggagctggcggggttcagacagcaggtccgggcgtccgccacatgggtctcgatggcggccagcttcagatgcttcataaaggtgcccgctgcctcccggccgcccttcagctcaaaggacaccacaccgcaggagccgtggggcaggtacttctctgccaaggcatggtacttgtcccctggcaggccgcagtagctgacggaggccaccttgggatgtgccgccaggaactccgccaccgcctggccgttctcacagtggcgggccatgcgcacatggaggctctccagccccaggttcagatagaaggcgttctgggggactggatggcgccgaagtcccgcatcagctgggcggtgcacttggtgatgaaggcgccctccctgccgaacttctccgcgtaggtgatgccgtggtagctgtcgtccggggtgcagaggccggggaacttgtccgcatgggccatccagtcgaacttgccggagtccacgatggcgccgcctaccgccgcgccgtggccgtccatgtacttggtggtggagtgggtgacgatgtcggcgccccattcaaagggccggcagttcaccggagtggcgaaggtgttgtccacgatcagcggcacgccgtgggtgtgggcggccttggcgaacttctcgatgtccagcaccgtcagggccgggttggcgatggtctcgccgaacaccgccttggtgttgggccggaaggcggcttccagctcctcgtcggtgcagtccggggagacgaaggtgacctcgatacccattttcgccatggtgacggagatcagattgaaggtaccgccgtagatggaggacgaggagacgatgtggtccccgcaggagcagatgttgaacaacgcgaagaagttggccgcttggccggaagaggtgagcatagcggcggtgccgccctccagctcgcagatcttggcggccacatagtcgttggtggggttctggaggcgggtgtagaagtagccgttggcctccaggtcaaagagcttacccatgtcctcgctggtggcgtatttgaacgtggtggactggacgatggggatctgccggggctctccgttgccgggggtgtagcccccctggacacatttcgtttcgatgcggtaatcgctcatggtgtgtgctcctttcgactggatgaagatgactttggagacgaaaaaacggctttcgtcccaaagaaaaactttgagacgaaagccgtcaggcttccgcggtaccactcaaattgcgccgtcctcacggcccgacgccccttttggggtccagcaacccctctgccctgacgcggcagtcctcggagaggccctaccggcggcgcgccgccctcgaaccctcggctcaggagccataggacctggagacccttgccgccggcttccaccgcccgccggctctctgagggcgccggtctccgtccctctccatcattgctttggaacatattatagccacgccgcggcaagtttgtcaactgcggattttcgcctcgcatggaccgcggcggcagtggacttttggcccggcctgtggtacgatggcccaaacggccggcggaggacgccggagagggaggagcgccatggcctttacgcccatcgacgagcagacctgggagcgccgggagtatctggaggttttccgccagaccgccatctatctgacggcggaggtggatatcacaccgctgtatcggcacacgaaggcccggggcgaaaagctgtatccggccctgatctggtgcgcggccgccgtgctgaaccggcatgtgcatttccgctacggccgggacgaggcagggcggatcgggatctgggatgtgctgcacccctattacaccgtgccccggcgggacgccccggacctattcgccatgaaggtcacccgctttatgccggactatgatgtgttccgccaggactttcaggcggactacgcccgggcggagacctgcggccgcctgctctgcgacgagaccctgcccccaaatgtctgcggtatctccgccatgccggggctggccttctccgccttcagcttcggcggggacctcaagccggacttcacgccattcgtcctgctggggaaggtccacccggcaggggaccggacggtgctgccggtaggcggagagtttgcccacgccgtcaacgacggcggccacatcagcggttttttcaaagagctggaggaaaccgccgccaaactgtttccggattgaaggagaaagagaccgcccgcggggatgcctgtccccgcgggcgtttttatcggaaagcagggcggggcaaaaaattccgcgctccccccttgacaagagatgtggctcatgctatattagccacacggttagttactagactaattaaccagataacaaaccggcaggaaagggggaaccgccttgacgttgacggaagaccggcccatcttccagcagatcgcggagcagctggaggaggcgatcctctccggggcctacccagaggagagccaggtgccgtccatcacggagtattcggtgcagtaccggatcaatcccgccaccgccctgaaggggatcaacctgctggtggacgcggggctgctgtacaagaaacggggcgtggggatgtttgtggcctccggcgcccgggagaagctccgccagagccggcgggagcggttttatcaggactacgtccagcggatggtgcgggaggcccggaatctgggcctgacggatcaggagttgctggaacttctggaaaggggaatgaaagaagatggccattgagtttcagcacatctccaagcggtttgcggacacccgcgccctggaggatgtgtctttgacctttgaggaggggaagatctacgggctgctgggcaacaacggcgctggcaagtccacgctgctgaacatcctcaccgggcggctgtgcccagatagcggcaccgtcgccgtggacggcgcacccgccgacagcgacgcggcgctgggcaagctgttcctggtgggggagaagaacctgtatcccgacgacatgaaggtgaagcgggccctggacacggcggccgtgttttacccggacttcgaccggagctatgcggagagcctggcaaagcagttcgaactgccgttgaacaagaagatcaacggcctctccaccggctacgggtccatcttccgtctgattttgggtctcagcgtcaacaccccctatgtgctgtttgacgagcctgttctgggtctggacgcccagcaccgggacctgttctacaagctgctggtgcagaaatacgcggagcacccctgcaccatggtggtctccacccacctgatcgcggaggtggcggacctcatcgagcacacggtcatcatccggaagggacgcatcctgcaggacgcgcccacggaagagctgaccgccgcctgctgggcggtgtccggccctgccggggtggtggacagctgggccgccgggcgggacgtgtttacatcctctgtgctgggcggactcaagaccgtctgcatccggggcggggggacagaggacctgcccgccgggctggagcggcggcgcgtggggctccaggagtattttatcagcctgatggaagaggaggatcagagatgaacacgcgattcggccgggccttccggtatgaggtccggaattatttccgggcagtggcgatcctgtggctggtcatggcgctgatcccggcggcgatgctggcaatcacctatttcctggccggagagacggctatggagggcagcttcaacggctattccattgccgtggggatgttcggccttgtgttgggcatggtgggcctgcgggagaatcagcgggtgctgaaccagaacggcgtgtcccgtcggtccgccttcctggcggacgtggccgccctggcggtggcggcggtgctggtggcagcgggtgtcacggtgattatgggcgcctatcaaacagtcttgggcggccagggccggctgctgattacagatctgtaccaggtgatctatgaaggaccctccgccggtgccgggatcggtggcctggtgcggggcgcgatcttctccgccgcggtgggctggatgctggcggccctggggcagttctgctccgccctgtactggcggctgaacaagttctggaccatcctgatttccgtgaccgtgccgctggtgctgatcttcggcagtgtgccgctgattagctggctgggcaccacctccgccgggcgggcggcggtggaggccctggcggctttcggacagttcctggccgcatccccctggaacgcggcggcggtgctgctggccatgggggcggcgttcttcgccctcagctggctgctgctgcgccgggccatgatccggcctgcaaagtaacagataaaagtgaaaagataaaggataagagatcttcccaaacaagggcatctcttatcctttatcttatatctgatatctccgggggcgctccatgtgtcctattgtccgcccacgatgcggctgtacgtgcgggtggtaaggccgtagaccaaggcgtagatggcgcagaacaccagcagcgtcccggcggcgcagagggcgaacagacggacgtcaaagaggttgaacagctccagcagtttgcacagcatggggaaggctgccgccacatggatgcccgccgtcaccaggggcaggaagaacaccagcagcacctgactgcggatggaggagcggacctcccggggactcatgcccacctgctgcatgatctgatagcggcgctggtcctcatatccctcggaaatctgcttgtagtagatgatgagcaccgtggacagcaggaacagcagccccagaaacacgcccaggaacaggaagccgccgtacatggtgtacaggtccacagcgttgtcctgatggctgatgacggagtacacgtcattggcgtccgccgccagcagggggtccacaaaggccagcttttcctcttccgtgccgtccaggtccacctggacacgaaattcccggtggactctgctggcatcccggtcgctgatggcggagactacggtctcatccgccaccaccaggaaaagctgcgccgtctggccggagatcaggatggagctgttgtatcggggaaagtccatgatggtcccagcgatgtgaaaagggaggtcttcgatatagaaggtatccggcaggtccagattctctgcctggaccagcacctcttccggctccaggtccacggtatggccggtgaggcggccgtagtcatcggcggtgagcaaccggatttcggtgctgacgccctcctgcgccacaagggtgaaggtgtttcctgtgtaatagccgacggtgtcccccggagtggaccactggagcagttccaccttccggcccgcgtctgctgctgcggcctggacccgttccagggtgtcctcgttcagtgttgtctcctgttccggcggcacttcgtccagggactggaccacgtccacatcatagggatacatccgctccaaagctccctccagcccggcgtacaggctgacggtggtggataccgtcaccagcaccatggtggagaggatgcagatgttggccaggcccacggcgttctgcttcatccggtacagcagccccgccacggcggtgaagtgcttgggctggtagtagtaccgggggctgttccgcaggtgcttcagcagggcgatggacccggcggtgaacaggcagtaggtgccgaccatcaccagcgccaccgccaggaagaaataggccagggcggtaaaggggtcctctaccgtcagagcggtggcatagccagcccccagagtgacggcccccagcaccaccagcaggcggcgggtccggggctcccgctccccggcactggcgctgtggagcagttccacaggacgggaccggagcagcccgaacaggttccacaccagcgtcagcaggaagaggaagccgaagagagcggcggtatcggccatgccggagaggctgatctcaaagccatactccaccggcaggtgggacagctgcaataggagcagcagcaccagcttgctcaacagcacccctgccgcgagcccgcccacaatggccgcggcggcgcagtagagcgtctcccacaccatcaggcgggcggtgtggcgcttctccagacccaggatgttgtacagccccagctcccgccggcggcgcttcatcacaaagctgttggcgtacagcagcagaaccgcggagaacagcgtcaccaccagccggcccaggtacatcaggctttggagatatccggcccccggacggaggccacaatgtcgctgaaggtcaggtaggagagaatgtagtacatggcggccgtcatgccgcaggagagcagatacggcccatagaaccggccgttgcgcatcagattcaccagggccaagcggggaaagaatccggacttacgcatggggctcaccgcctcccgccaggaccgtcagggtgtcggagatccggcggaactgggcctcctggctctcgccgccccggtagagctggtggtacacctgtccgtcccggaggaacaacacccgtccagcgtggctggccgcctttaccgagtgggtgaccatcaaaatggtctgcccggtgccgttcagttctccgaacagctccagcagggcgtcggaggaccgggagtccagagcgccggtgggttcgtctgccagaatcaactgggggtccgtgatgagggcccgggccacagcagcccgctgcttctggccgccggagacctcataggggtatttcgccaagatgtccgagatgcccagctgatctgcgatggggcggagcttttgctgcatctcccggtagtctgtgcccgccagcaccaggggcagatagatgttgtcctgaagggagaaggtgtccaacaggttgaagtcctggaacacgaaccccaggtgggaccggcggaaggccgccagatcccgctcccggatggcagagaggggcctgccctccagtaaaacctccccggcggtggggcggtccagggccgccaggatgttcagcagggtggtcttgccggagccggactcacccatgatggccacgtactccccctcctccacggagaagctgacgttggacagggcctggacctgcgtgccgccgaagcgggtggtgtagattttctgtacatgctgtacttccaacaatggcatcaagattcctcctcgtatcggatcatgcctctattgtagccaaagggccggactgtctgccatggatttggcttacagtccggcccgattccttacagtttcgtcacattgggtcactccaccacccgtcggccccgggagaggtccagccgcaccagcgtcccctgcccggggcgggagacgatagagatcccgtggttcagccggtccatcacccggcggcacaggtacagcccgatgccggtggatttcttgtcctcccggccgttgtagccggtgaagcccttctcgaacacccggggcaggtcctccggccggataccgatgccgctgtcggcgatgaccagcgtctctccgtccccgtagatccggatgcggcccccggcgggggtgtatttcagggcgttggacagtacctgctccaccacgaaggagagccacttcccgtccgtcagcaccgtccgcccggtctcccgaaagtccagggtgatctttttcagaatgaacatccgggcgaacttccgcaccgcctgccgcagcaggccgtccaggtccgtgtcccggaggacatagtccgtgctctcgctgtccagccgcaggtagcccagcaccatgtccacatactgctcgatcttcaggagctccacttccacctccgtgcccacagcgccgggatcctcctgcaagagcagccgggccgcggcgatgggggttttaatctggtgggcccagagggtgtagtaatccgtcatgtcctccagccggtcccggttctccgccgccagacgcacccggtcggcgcagaccgccctcagcagggcctgatagtccgcctccagtacgccccggggcggcggcaggggcagcaccgactcatggacctttcgtaaaagcccttccagctcccggtgccgccggagaaaggcggagtaccccagggcaaacaggaccagccccagcattaggcagagaaggcctgcataggcaaccgcctccaccggcaggctgtacagggcgaacacggcggcgaacaccgccaccgccccggccagcagcaacagcagcttccactggcgcttgagataggctgtcagcattccgtcacccctccaccagatatccggcgcccttccgggtgcggatgaaatccgggaggcccgccgcctccagcttccgccgcagccgggcgatgttcaccgtcagggtgttctcatccacaaagctgtcggactcccacagccgggtcatcaatgcgtcccggctgacgatctcccccttgtgctccagcaggagctgcagaatccggcactcgttcctcgtcagctccacccgctgcccgtgggcatccagcgtcccatcagacacgttcagcaccgcggcgccgcaggagagcaggtgggaagacgggccgaagtcgtaggcccgccgcagcagggcctggaccttggcggagagcacctgtaaatcaaagggctttgccagcaggtcatccccgcccagctgcatggccatcaccacgttcacattgtccgaggcggaggtgagaaataagatgggcgccttggagacccggcggatctcctgacaccagtggtagccgttgaagaaggggagggagacgtccagcagcaccagatgggggtcgaaggcggcgaactccgacaagacgtcgtcgaaccgctccgcgcagcggacggtgtagccccagccctccagatggcggcggatgaccccggcgatggccgcgtcgtcctccacgatgaaaatgcggtacatgagcccctcctctccccccgcggtcagttcagctccagggactccagctgggagatgatctcctgctggcgctcgtagaacagcagctcctggttgtgggtgaaatacgcgtcgcagccgtagcggctgatgaaggtggcggcgtagtagttgatggtcagctccgtcaccaggatcagcagctcctgcccctccgggaacacctcctcgcagaaggcgaagaggttgttcagcatctccccggcggtcttggcctgggctttcaggccctggaccatctggtcgaagtccgccttcactgcagcaaagcccgtctgactgtccacggtctgtccagccagggctttctgccgctccagagcggcgatgatccggcggtgagagcgctccgcctcctgggagagactgccagaccgcctgccggtgtcgatgcgggtcttctgacggcgcagctgttcctccagcagagcggcgagatccgcctccggcgcggtcagggcggctttcacgtccttcaggatgccaagcagctcccgcagcatctcctcccgctccaccacggagcgcagctcgccggtggcggcgtccagcagcagacccagcagggacagccgctcgtcgaacttggcggcagaggcacgctggcggatggccttggtggccttgccggcgaggatcttgtccacctggtagtcgctgcggtacttgttgaacaggtcgtagtaaaccgcgaactccttggcgatcttgggattctggagatattggatgatgagcttctcatccaccggcaggtggttctgctcgtacaggtgaatcatctggctcaggtcatcccagccccgggcggtgacgaaccgcttgccgttcaccgtggactccaccttgtagaagtcacccttccggatctccaggtacgtcatcaccgccggatggacgtgcttctggtaggcaaactccttccaggcatcgaagtccggctccacgtcgatgcgcttgagccggtcccaggtaacgatgtcgaactcccggacggagcggttgtactccggcgggttgccggcagtgaccacgatccagccctccggcacccgatggcggccgaagattttatattgcagaaattgcagcatggaaggggccagcgtctcgctgacgcagttgatctcgtccaggaagaggatgccctcctttttgccggtggcctccatagtctcgtacacggaggcgatgatctcgctcatggtgtactcggagacctggtactccttgcggttaaagaccttcttctcaatgaagggcagacccagggcgctctgccgggtgtggtgggtcatggagtaggacaccaggcacacgtccaactcctgggcgatctgctccatgatggcggtcttgccgatgcccggagggcccatgaggaacacaggccgctgcttttccaccggcactgcgtagctgccgaactcatccttggtgaagtatgccgtcatggcgtttttgatctgttccttggcctctttgatgttcatggtcattcaacctgactttcctcagtatcggtatgattcaaagcgcaaattccgcgtccagaaaatctgtgtccgccccagccgtctcccggggccagcggcggttgcagtagtccagaagaaaggcggtggcctctgtcagacggctgcgcagcaacaggtccaccgcggcccggcagttgtcctggtccagaaagcccaggtctgccagctgcagcagctggcggcgcagggcgtcgttgtccgtcagggccaagttccggcgcagatgctccagataatgttccttgggccgcatgtgccggaagtcgttggtgccgccgttggtgtagaactcctgataggagtggccccgcagcagggccagcgcgtagatcagccgctcctctccggtgaagcggtcctcctgccggtagcaggcgccgatctccggggcgtacccttcctcttccaaagagaaacccagatagaaggcgtattccagccgcttcaactgggcgtagccctggcacaggaagatattctcccgggaggtgtcctgccggacggtgccgttggcggcccgctcgtccaaggcggccatcaggcagtcccagtggaccatggcgtgaatggggcgcatgcggggggccgcaatagcggtcagcgccggggagatggggcgggcgccgatggcgttggtggccagccggaagagaaaggcctcctcgtcggccagcttctccgacagccagtccaggctgtcctgaaaggcgaacacatccgccgtgccgccgtattccacgatccgcaggttttcaaagcgattcaggccgtaaaaggcatccacatccgggggatcaccagaatctccacgccccgcagggcgggcacggccttggcactgacccgggccaccggcccctccggctgcaccacggcccggcggccctccagccgcaggcattccacttgtgtttccatggttcagatctcctcgctctgtaataccagcttgatggcccacaccggcacgtccggcgggtcgtacccgtcgtccagaaaaacgaaggccgcgtcgtagtccggctttttctccggaaagatgccgcggccgtcggtgaagtagatcatgcccttgaggttggtgaactctccggcccggaccagctcgtccacgtactgaaacaccgggcggaagtccgtgccgccgaagccgtggagctgcatggtgtccagatagttgtcgaagtccttctggctggtgatcttccggtcctcctgcacctccgcgtcgcactggatgatgtggagattgatcttggtgaagaagttttcctgctggcgcaggatgttgtaggtcttggtgacgaaccgctgcaccaggtcgccgctgacggagccggaggtgtcgatggcgatgacgaattccttgatccgccggacctccttgtactccagcggctccaccaggggcatattgccgtacagggacagaccgtaggtgtagtagatatagtcgaactcgtcctgattcacctgggtgacctcgcccaggctcatatagcggcggaggaagtccgcatagtcatacgtctcccggttcaccgccttcagctcctggaccagattgccggcatcggtgccgtggcggcgggatatggtctccaggtccacctggagtcgctcgctgatctcccgccaggtctgctccaggtcacggtcccgccgttccgtgccggacttgggcgtccgggcccggctgccctggccgccccggccggacttctgcttgccgggggtgccggtctccggtgtccggccgttggactggctgcctcctccggcgccctggccgctcttcaccggcagataccaggcccggtggtcgtccgccaggaaggggtcccgcagccgggccatctgatcgtcggagagctgccggtccagaaagtaccggtagagcttctccgccgtcaggagccgcacctgggagcggagctccttcagcgtctcctcctgggcataggcccggttgcaggcggcgctctccaggtggaggtcctcaatggcgctttccaccgcgatgtcgcaagccaggtcccagcaccgacggtcgatgttggcgctggtgaacaggtgccggaacacacagtggagcacgatgtgcaggtagtcccgcacattccggccccgctcccgcttgtacatggacaggacgtagtacgtgtcgtaaaacaggtgctggccgtccgtggccagggtacctggataggaggtcagctggaactggctgagggccagatccagaaaccgaaggttcaccagcagggtgttccgggtcaggcgcaggatattctgagccagggcgtccgcctggcggaatttttccacatgatcttccataagcacaactcttcccgaaagggcgccgggcgcccgatgttctgaccctttattttagcatggggataccggcaatgcaagaaaaacgccccggacggcgtcttgcgcccgccgccgggagatgatatgataaacctgtatgaacacgaaagatggagtggagacatgagaaagctggtcgttggaatattggcccacgtggacgcggggaagaccaccctgtcggaggcgctgctgtatcagagcggcgccctgcggcgcctgggccgggtggaccaccaggacgcctttctggacacggacgccatggagcgggaacggggcatcaccatcttctccaaacaggcggtgttttccctgaaggacacggaggttaccctgttggacacgccgggccatgtggacttctccgctgaggcggagcggacgcttcaggtgctggactgtgccattctggtcatcagcggcaccgacggggtccaggcccacacccgcaccctctggcggctgctggagcggtatcacgtccccaccttcctctttatcaataaaatggacctggcgggggcagaccgctccgcagttctggcaggcttaaagcagcgtctgggcagcggctgtgtggatttcagcggcgaacgggacgaatcgttccgggaggaggcggccgtctgcgatgaatcagtgctggagcggtatctggagaccggagttctgacagacggcgacctgcggcgaatggtcgggaagcggaagctgttcccctgctggttcggctctgcgctgaagctggagggggtctcggaattcctggagggggtggaacagtatgccccggttcccgcctatccggagaccttcggcgcccggatctacaagatcgcccgggacggccagggcacccgcctcacctatttaaaagtgacaggcggcaccctgcgggtgaagagccttttgaccaaccgccgccccggtctgggagaggaccaggtgtgggaggagaaggcggatcaaatccgcatctactccggcgccaagttccgcacggtggaggaggccccggcggggacggtgtgcgccgtgacaggtctctcccgcagccgggcgggagagggcttggggcttgaggccggctggactgccccggcgctggagccggtgctgacctatcaggtgctgctgccggaggggacggatccccacactgccctgggcaatctgcgccagctggaggaggaggatccccagctccacattgcctggaatgagcagacccgccagatccacgtgcagctgatgggggagatccagctggagatcttacaacgcatgatccgggagcggttcggcctggaggtggccttcggccccggcaccatctgttatcgggagaccatcgccgccccagtagagggcatcggccactttgagcccctgcgccactatgcagaggtccatctgctgctggagcctggggagcggggcagcggcctggagttcgggacggcctgcccggaggaccagctggagggccgttggcagaggctggtcctgacccatctggcggagaaggagcacctgggggtgctgaccggctcccccattacggatatgaagatcaccctggcggcgggccgggcccacgtgaagcacacggagggcggcgacttccgccaggccacctatcgggcggtgcgccaggggctgatggaggcggagagcatcctgctggagccctggtacgacttccgcctggagctgcccgcacctcaggtaggccgggccatgacggacctccagcagatgggggcgcagctgtctccgccggagacagcgggggaggaggctgtgctcactggtgctgtggcggtgtccgctctgggggactacgcccgggaggtggccgcctacacccagggccgggggcggctgctctgttccctccggggttatgcgccctgcgcggaccaggacgctgtgctggcgtccgtcgattacgacccgacggcggatttggacaactccccggactccgtgttctgtagccacggcgccggcgtcatcgtcccctgggatgaagtgcccgcccgggcgcacgtgtccagcggcctggacctgggaccggagaaagaggagctggcggggaggtctgatacccggcgcgcctctgtctacgctgggaccatcgagcaggataaggagctccaggccatcttcgagcggacctacggccccgtgaagcggcgggcctttattcccccgaaagacccccggcgccctgctccgacagcggaggcagagcaggaaaagcggaccatccgggagcagttctccggaccggagtacctgctggtggacggctacaacatcatttttgcctgggatgagctgaaggccatcgcccgggacaatctggacgccgcccgcaagcagctgtgcgatctcctcagcaactaccggggcttccggaagtgcgaggtcatcgccgtgtttgacgcctataaggtcaagggcggccagggcagcgtggagaagtaccacgacatccacgtggtctacaccaaggaggcggagacggcggacgcctatatcgagcgggccacttacgagattggccgccgccatcgggtgcgggtggctacctccgacggcccggagcagctgatcattctgggccacggggccctgcggctttccgccagcgccttccggcaggaggtggagcaggtggaaggccagatcgcggacatcctggccgccaacaaccgcaggcagaagaccggaaacgtccgctccgccctggagcgggcccagagacagacagaggaggagaagccatgatcggattgagctgtaccgcaggcgcggtgctggccctctgcggccaggtccgcggaaccctggagcgcaaggggctgccccaaaaggagctggacggcggccgggtgcggatcgaaccccggtacaaccagggctccggcttcggccttgtcccgctgaacggccggcagatggcccccctgtccctggcggcgctgtgggcgctgctgggggtgtgcggcggccggggcctgggggccggactgctgctaggcggcggactcagcaacctgtgggaacggatccgccatggacgggtcctggactatctgcgctttccaaaggcgccggggccgctgaagaaatacacctacaatctggcggacctggccatcttcctgggcgctgtgctgatggtgctgcgccgcagaaggcagtaatatgagccgccctgcgtgattccacgcagggcggctctcttcataaaaatttaagaaatttcacagttttttcgtaaaccaagggaatctatactgaatttacgaaaaaaacacggaactgtaactgatttgtaaattgacaattagttgtgtttgtgtatatactaactgtactagtacgggcagtacagtttttttgaatggcttaaaaatttgtcattgacaaatttcaaaattgtgttactgtattattagaataatacaaaaagagacatcgtaacggaccgcactctgccgcgtcttatgtgagacattttacagacatttgacgcaaacgccgtgggatgttgatctggtggcgttatactggaactgaaaaaatgttccggaagttgaagcgttcggcggggctgcgtcgtataggagaacaagacgaaagaagggaacctgttatgaagatcctgattaccacagattggtatacgcctgcggtaaacggtgtggtcacctctgtgaaaaacctgcagcgggagttggagcgccggggccatgaggtccggatcctgacgctgtcccagtcgctccactcctggtcccgggacggcgtcaccgccatcggctccgtaaacgccggacggatctatcccggcgcccgcctccgcaccgccatggcgggccgctgggtacgggagctgatggactggcggccggatgtgatccactcccaatgtgagttcagcacctttttcctggcccgccgcatcgcagaggagctggatgtccccctggtccacacctaccacacggtgtatgaggactacacccactacttctcccccagcgtccggtggggccgatgtgcggtggcggctttctcccgctgggtagctgcccaggtggacggcatgatcgcccccaccggcaaggtgcggggactgttgcagggctatggcgttcgctgcccggtcttcgtggtgcctacgggcatcgacctgcggcgcttccagcaggagggcgatcccatgcgccgggcggttctgcgggccagcctgggcatccctgcggaaaacactgtgctggtgtgcgtggggcgccttgcggaggagaagaacatccaggagctgctgaagctccgggcctccctgggcagccgccctgtgacgctgttgctggtgggggatggtcctgaccggccccggctggagcaggtggcccacgatctgcggctggaggccccggcagtgatctttgccggcatggtgcccccggaggaggtgccggagtggtaccggctgggggacctgttcgtcagcgcctcctccagcgagacccagggtctgacctacatcgaggcactggccgccggcgtgcccgccctgtgccgggcggatctctgcctggagggcgtcatcctggagggagagaacggctggcagtaccacagcactgtggagttccggcagcggctggaggagttcctggccagcccggagacccacgaagcgctgaagcggcgggccgcagagagtgcggagcagttctccgcccagcggtttgcccagcgggtggagcgcatctatcagatgcagctggcccggcgggcggccagctgtgtccagggggtgaccgcatgagccggggcgtggaaaagaccgctctgcaggcggcgtccctcttcggactgattttgtgcgtgctgaccggaatctgggcctggcaggcaggactgctaacctcccaggagcggctgcaggcctttgtggccagctgcggcgccgccggcgggctgctgttcgtggcgttccagatggtgcaggtagtggtgccggtgctgcccggcggcctgggctgcctggtgggcgtggtgctgttcggcccggtgatggggtttgtctacaattatgtgggcatctgcatcggttcgctgttggcctttgccgtggcgcgcaactgcgggcggccgctgttgagcctgctgttttcggaaaagctcatcgccaagtacagcgattggacagagcggaatgaccggtttgcacggctgttcgccctggcgatctttttcccggtggcgccggacgacttcctgtgctatctggcgggtaccacctccatgacctggcggcggttcaccaccatcatcctgctgggcaagcccctttccatcgccctgtacagcctggggctgacggtgctgttccagcagatcacaggctggctggggtaaagacatccgcggacgggcggatcggtaaaggagacacacatgcgcgtttttatctacaatggcggcctgcgcctggtcggcaaaagcggtgtgggacaggccatcctccaccagcgggagatgctgcgccgggcccggatcgacactgccgaccattggtgccagcgggccggggccgtccatatcaacacggtgctgccggattcggtgctggcggctctggcggccaagctgatggggcggaaggtcatttactacggccactccactatggaggatttccgcagatcctttcgaggctcggaccggctggcacccctcttccgcaagtggatcaccttctgctacagcctgggcgacgtggtgctgacccccacggaatactcccgccgtttgctggagagctacggcctcaagccgccggtgtacagcatttccaacggcgtggatacagagttcttcgcgccggatcccacccggcgggcgtccttccgccgccgctggggcctccgggaaggggagcgggcggtgatttccgtgggtcacaccattgcccggaagggactgccggaattcctggagctggcccggcggatgccggaggcccgtttcctctggttcggctggacggatccccatctgatccccaggagatccggcaggccatggaacaggcgccggagaatgtgaccttcgccggctttgtagaccgggagacgctgcgggaggcatattgcggcgcggatgtattcgccttcatgagtcatgaggagaccgagggcatcgtggtgctggaagccctggcctgcggcattcccacagtggtgcgggacatccctgtttacaacggctggctgcgggagggacagaatgtctacaaggcctccggcacagacgagttccagcagaaggcggaaggacttctgacagggacattgccggatctgacagccgccggccgccgggtggcggaggagcggagcctgtcggtgatgggggagcgcctgcgggaggtctaccggcggatggacattctgccggcagcgcagccggcggcaaaaacgaacctccctcaggcggagagacccgtacagcacagcttcacaccttaattcccggtattcctacgggataaggataccctggcgagggatggttccccatagcgcccgcttccattccggttctgcgggccgccgatgaagagaaaaagcgcctccggcaaaagccggaggcgcttttggcgcgtttactggggcagcgtctggaccacgccgcgggcacagtccacagagaccatggcaccgtccttcaggcgctggacggcgccggcggcgcccacgatcaccgccttgcccaacgtcaggcccacagtggccgcatggccgttggtgccgctctcctcgctgatgacagcggccgcctgccggatatagggcaggaggtcgttggtggtgtagggcaccaccagcacatccccggggcggaacttggcggccacatcctccagtgagcggcagacgcacagggggccggaggcgttgctggcccccacgccgacggcgttgagcagggccccgcccaccagatggaccttgatcatattggtggtgccggagacacccacgggcacaccggcagtaatgaccaccagatcgccctgcttcacgagttctgccttctctgccgcctggatggcgaactcgatcagctggtcggtgttctgggcatagggcatcagcaggggcaccacgccccagtacagggccatctgccgctggacccgctcactgagcaggcaggccaccaccgtggtgccggggcggaaacggctcaccagccgggcggtggcaccgctctggctgacggtgaggatggcatcggcaccgatgtccatggcagtggtgcaggcggcatgggccgtggcggcggcgatggacaggcggctggaacccggcaggttgcgcatccgcttggcgtagttgatgtccgcctcggtccgcagggcaatggcatccatggtctgcaccgcctccacggggtatttgcccgccgctgtctcgccggagagcatgatggcggaggttccgtcgtagatggcgttggccacgtcggtgatctccgcccgggtggggcggggattctccatcatagagtccagcatctgtgtggctgtgatgacaggcttgccggcggccacgcactgggcgatcatgtccttctggatgatgggaatctctgtgaagtcgatctccacgcccatatccccccgggccaccatgatgccgtccgccacggacaggatctccgccaggttgctgaccccctcctggttttcaatcttggcgatgatctggatggaggagtctgcctcatccagcaggcggcggatctcccgcacgtcgtccgccgtgcggacgaagctggcggcgatgaagtcaaagccctgttccacgccgaagaggatgtcctcccggtcccgctggctcatgtagggcatggacaggcggatgcccggcacattgacgcccttgttgtttttcatggccccgtcgttttccacccggcagcggacgtccgccgctgtggtctccagcaccgtcaggcgcaccaggccgtcgtccagcaggatggtgtcgccggccttcacgtccccgggcaggtcggcgtaggtgatggagcagccttgctcatcccccacgatgtcccgggtggtcagggtgaactcctggccggtccgcagcatgacggaacctgcggcgaaggacttcagccggacctccggccccttggtgtccagcatggcggccaccggcaggcccagctccgcccgcagggccttcagggcgtccagacgacccttgtgctccgcgtggctgccgtgggagaaattgaaccgggccacgttcatgccggcctccagcatctgccgcaggacgccctccctgtccgtggccggaccgagggtgcacacgatctttgtctttctcataaataaaaatccacctttcggtcaaaagggatacaaactgtaagacagtttatcacaaagccgcagcgcaaaaaagtggaaaagtgttcaataaacaagagggatccgccaaaaggcccgtcagcgcgggaaggctcacatccccagcttttcccgcagggcggcgatcatctcttgatattcgccctcggagagcagcaccggcttcggattcgtgatggcaaaggaaccgccgaactcgaatccgccctcgtatttgggtacgatatggaagtgcaggtggggattcgtatcgccgaaggagcccaggttgatcttgtcgcagccccacagttccttcactgcaccggaggcccgggccagatcccgggcgaaggcggccagctcctccggcccgcactcgcacagctccttccggtggttcttcagcgccagggcgcagcggcccttgtgggcctgatccttgaagagatagagcacaccggcctccatctcgccgaccttgtacatgatggcctcccggccctcgtgatgttcatcgcagtaaaagcatcccatggctagatctccttttgtcagaatacggaggaaattttccccttattaccatacaacccaaaaccgccgccgtcaagcatcagttcaggattgcgccggggcagaggttctggtatcatcagggtatcaagaacgaagacggaggaggaatcgacatgaaactcggcttggtgacggacagcctggtagaccgctccctggcagaggcagcggccgtctgccggggactggggctggagcaggtggagttgggctgcggcaactggtccccggcgccccatgtggacctgaaagggctgacggcggacgccggtgcccggcaccggctgctggatactctgggggaaaacggcctcacgatctccgccctgaactgctccggcaaccccctgttccccggggagaagggagccggagacagggcggtggcggagggcacgttcctcctggcggagcagctaggggtggagaccgtggtgatgatgagcggcctgcccggcggctgcccggaggaccgcactcccacctggatcgtcacgtcctggccgccggagacggaggaaatcctccgctaccagtggaaggcggccgtcccggtgtggaaggcgctggccgcccgggcccgggaccacggggtgaagcgcatcgccctggagttccatggctggcagctggtgtacaatgtggagacgctccgccgcctgcggagtgaggtgggagacgacattctgggggtgaatctggaccccagccatctcttctggatgggggcggaccccgtggaggtggcccgcgccctggcggactgcatctaccatgtccacatcaaggacgtgcgcctggagccggctgccgggcagaacaccctgctggacaccaagggcgtgctggagttcgccagccgctcctggaacttcgtcacccccggcacaggccacgacgccgcctggtggcgccgctttctggagacgctgcaggactgcggctacgacggcgccctcagcatcgaacaggaggattacaccatcccgctggaggaggccctgcagaaggccgtgtccctgctgcggcaggcgctgcccgcctgaaatacgcaaagccccgcctcacgaacgaggcggggcttttttcagaacaggatcaccgcaggaaattccagtacagggtaatggccgccgccagcaggagctgcacggccaggatcaccggcacgcccacccgaaagacccggtggagcgtcttgtggcggaagaggtacatccccagcagggcacccacgctgccgcccaccacggccagaagcaacagatttttctccggcacccgctggcggaaccgggggtgtttggccaggagcttgtctacgccgaagatcaaaaaggtcacagtgttgatgagcaccagccaggcggccagcagccccaggggagagccgatgaaggcaacgatacggtcattgtgctctgtgggcagatagagtgtcttttcttccataacggccgcctcctgaaacagcactggactggccgggagttcccagccagtccagtgtagcagaagtttcagtttttggcaagcttgctgagttccacagcagtggctgccgccagcttggcgttgttgtacaccagctggatattggaggccagggagtcgccgccggtcagatccttgatcttggccagcaggaaaggcgtggtctccttgccgtggatgccctgagccttggcctcctccacggcctcgtcgatggccttgttgatgacatccgcgtccatggagtactcctccgggatggggttggtcaccagcatgccgccgcccaggcccatatcctgcttgacataaaaggctttggccagctccgccggggtgtcgatctcatagtccacggcaaagccgctcttccgggtgtagaaggcgggcagctcgcgggtgccgtagccgatgacgggcacgccgtgggtctccaggtactccagggtcagccccaggtccagaatggacttggcgccggcacagaccaccatcacgggggtgtgggccagctcctccagatcggcggagatgtccatggtggtctcagccccccggtgcacgccgccgatgccgccggtggcgaacacggagatcccggccatgtgggcgataatcatggtagtggtgacagtggtggcgccgtccctgccctccgccaccagcacgggcagatcccgacggctggccttggccacggcagggccggtcttgcccaggtagtcgatctcctcgggagagaggccggccttcagccgcccgccgatgacggcgatggtggcaggggtggcgccgtgttcccggatgatcttctccacgttcagggccgtctccacattctggggatagggcatgccgtgggagatgatggtggattccagtgccaccacgggacgaccctcgtccagggccttctgcacttcaggggcgatgtcgagatacttgttcagagccatgataaaaacctccagatttgaattttggttattcgatggggaatggggtgtcaggaattggaaatggggggaccgggaactttaaagcccagcccgcagcttcagcgcttccgcgctcatggcggggttgatggtctccgccccctccatggcgatggcggaggctgccagacccgccttggcggtgcccgtcagatccgtgcccgcaagataggcccaggtgatggctgccatgaaggcatccccgcagccggtggtgttcaccatctccgccggcaggacgggcaggtgcacccgctccccggaacggtcggcggcgaacacgccgtctccgcctagagagatgaatacccggtgaagaccggtggccagcagggcgtccgcggcggcgcgcaggctggcctcatcggtgatggccacgccggagagcagctccgcctcgatgcggttgggcttgagggtgtggagcctgcccagcaccggctgcaacttcaccgccttggcggtggagaccgggtcggcaaagataggcaccgggcagttctctgccagataggcgatgctctccgcgggaatattggtgtcgatcaccagcacctggctgccggacagcagcttctgccgctgagagagcagctggggtgtcagatggcggtagatgtccatgtcactgaccgccagcagcatgtcgcccttctcgtcattgatgaagagataagtggaggtgtgcccctccgggatcaccggggattgggagatgtcgatgcccagttccccgcagctggcggcgatcttctgggcgtacaggtcgtcgccgaaggcggtgaccatccgcacgtccaggcccagaaggctcatgttgtgggcgatgttccggcccacgccgcccagactcatccgcaccgcgccggggttggagtcccggtccaccggcacctccgacggccagccgccgatgtccatgttgacgccgcccaccaccgtgacatagggcgctgtatggacgatgtagcctttgccggtgatgtagcccttcttcatcaggttggagatgtgcaccgccacggaggaccgggtgatgccggccttctccgccagttcctgctgggagatgagagggttttcttcgatccagttcagaatctgccgttcccgctgggtcatggcgccgcctccttgtaagcaaaaattaagatatataatctaatgcttagtttatctgtttttttgaaaaagtcaagacccaatttttagccgtcagccgtctgtgggacggggatgcccgcttcgcctgccgcaggtaccggacagagaggtgctgatggggcgggagcttcatgttctcccagcggaataaaaatcgcgccggaagtggaaccaaaccgccgcctttgccgactatacaggcagaggaggcgatgcttcatgaaaaaatggtgcctgtttttgagcctgtatttctgtatctgtctgctggcagcctgcgccggaggggacgtctccgccggtgcgggggccgattccggcggcacacccgcggaggagacccggaccggaggagagacgacggagcccggccgggtgacggagaccttccggctggtgactgtgggggacggcgatgatccggcttctgtgctggccgggacggacggcggggccggagctgtgtacaccctggacctcttcagtgtggaagacctgactatcgagggatacacccaggaggagatggacctgctggactggtctcccatgcctggcgctctggtggaggtcacctgggacggctccgtcatggagtcctaccccatgcggttcggcacggtggcctccgttcgcatcctggaggacggctttgacgatctgtgccggctgcacctggacgtgctgaacgatctctgggaggtggaccccagcctgaatgatggcatcacggagctgggggtggacctgtccgggacctccctgccggaaagcgaacaggccgcggtggcctatgccttcggctccgcccacgggctgatggctatggagggcacatatcaggacttcgtggacagcgggtatatcgacggggaagcactgttctggaaggacggctgcctgttctccgtcaaagagacccaggatgaaaacccggtgacctttaatctgcccagtttcggtcctggggacgagatgccggactacagtggcgtccgctttgacgcggagaagtggcgcagcggcctgggggcctatttcttcacagactgcaccgctgtccgaaatggcggcggccagtggggcgattacaccgtgggggcggaggcgatcgcctgaaaaccgggaaaacgcccgttccctcttgtaaaactatttgaaatggagtacaatatccatgattatgcagccatttccagcaaaaacaagaaaacgggtgaagtttatgagctatacgaaaatcgcggccatctacgccgacagcgaggcactctccggccagacggtcaccgtgggcggctgggtccgcaccatccgggacatgaagaccttcggcttcatcgagctgaacgacgggtcctgcttcaagaatctccaggtggtcatggaggccgggacgctggagaactataaggatatcgccgcccagaacgtgggcgccgccctgatcgtcaccggcaccgtcgtcctgacgccggaggccaagcagcccctggagctgaaggccgcctccatcgaggtggagggcacctccacctccgactacccctgcagaaaaagcgccacagcgtggagtttctgcgtaccatccagcacctgcggccccggacgaacctgttttccgccgtgttccgggtgcggagcgtggcggcctacgccattcatcagttcttccaggagcggggcttcgtctacgtccacacccccatcatcactgccagcgactgtgagggcgccggcgagatgttccgggtcaccacgctggaccccaaaaatccgcccatgaccgaggatggggaggtggacttctcccaggacttcttcggtaaacctgcgaacctcaccgtctccggccagttgaacgcggagaacttcgccatggccttcggggacgtatataccttcggccccaccttccgggcggagaactccaacacccagcgccacgccgccgagttctggatgatcgagccggaaatggccttcacagacctgaagggcgatatggatgtggcggaggccatgatcaagttcgtcatccgtcaggtgatggaaaagtgccctcaggagctggcctttttcaacagcttcgtggacaagggcctgctggagcggctggagcacgtggcctcctctgacttcggccgggtgacctataccgaggcagtggcgattctggagcagcacaacgacctgtttgactacaaggtctcctggggctgcgacctgcagacggaacacgagcggtatctcaccgagcaggtgtacaagaagccggtgttcgtcacggattatcccaaggagatcaaggcgttctacatgcgcctcaacgacgatgggaaaaccgtggccgcggcggactgcctggtacccggcatcggcgagatcatcggcggcagccagcgcgaggagcggctggaaatcctggaaagccgcatccgggagctgggcatgaaccccaaggactactggtggtactgcgacctgcggcgctacggctcctgcaagcacgcgggcttcggcctgggttttgaacggctggtgatgtacctcaccggcgtcagcaacatccgggacgtcctgccccacccgagaacggtcggcagtgcggacttttaaaaaataaaatcgactccggcgccctgtccatctgcttggacagggcgccgttttttgcggttgtggggacggagggcggtacccttctgcgcattgccggcggtccgctgcaacagtttttcttgaggagaggcggggccctagtgtatagttaggaaaaactcaaaaggaggaaaaaaatggaaagcgatacaatggaacttctgcgcctgatgctggcgcatctgcggcccaggcttcagggacgggacgaagagtggcaggcgctggagcggaagcagcaagaactgatggccagcttccgggaaacccacggcggggacgtgccgctgctggaggaggtcctggagatggaggacgcctgggctggcgcgggagaacgggcctgcgccgcccacttctttctggggctgcaaatgggcctggacctggggaagctgaactatctgcgggaggaataggcgctgccccggagtgcgcgtgaaagagagcgcccggaccacgtggcccgggcgctctctttcagttagatgaagaactgtgccggatcaggccagcacccgcacgcagcggtcgatgagggtcatgtggaccgcttcgccctctgcgaagcgcttggacagctgggggttgtagacctccacgatgatgggctggtcgcccagcatgacctcgtactccactttggcaccgtagtaagtggcccgggagacacggccggacagggggccctcttcctcagagaggagaatagactccggacgaaccgccaggcagcaggggccgtccttctggacgccctccatcttgccgggggcggggatggggaaggtgtggccgcccacttccaccagggcgttctcgccgtccatgccgcggaaggtgccgtcgatgaagttggccttgccgatgaagttggccacgaaccggctgttgggctgctcatagatctctgtgggcgtgccctgctggcagatgacgccgtccttcatgatgaccacccggtcggagatggccatggcctcggactggtcatgggtgacataaagggaggtgatgcccagccgtttctgaagggcccggagctcgtcccgcatgctctcccgcagcttggcgtccaagttggacaggggctcgtcaaacaacagcacgctgggctcaatgaccacggcgcgggccagggccacccgctgctgctgtccgccggagagctggttggggaaccggcgctccataccggtcagctgcatcagctccatgacggcgttggtgcggcggaccacctcatcctgggagaccttggccactttcagaccgtaggccacgttctcccagatgttcagatgggggaacagagcgtagctctggaacaccatggagatgccccgcttgttgggggggatcttggcaacatcccgctcaccgataaacacgctgccgctggtggggtactcaaagccggagatcatccgcagcgtggtggttttgccgcagccggaagggcccagcagcgtcaccatctcgccgtcctggatgttcaggttgatgtggtccacagccacgaaatccttgccggtatccggctgctggaagatcttggtgatctcttttaaaaccacgccggagctctttttgcccagcgccgacttttccatctgcttgctcattttgtttcctccgttttctcgtgaatgcctgcgcccttgggcaccctggagcggggggccagcagcaggttgatcaatccgttgaaaatgccgataaacaccagcaggattacgaccatcatggtgacgaaggccgcagcctggctgtattttgcctggtcaaagagcgtgtagatcttgctggtgaccagatcccagcggggagagaccaggaagatgatggcgctgacggcagtgatggccttcacgaaggagtacaccaggccggagaagaaggcgttgcgcagcataggcagggagatccggcggaaggagtagccgctgccggcacccagaatggtggaggcctcttcaatggagttgtcgatctgcagcagcgtggtggtgccggactcaatcgccaccggcatattccggaacacgaacacgatcaccaggatggcagcggtgccggtgagcactaggaagccggtgttgaaggccaggatgtaggcgatgcccagcacagtgccggggacggcgaacatcagaacagaggacacctcgataaaccgtttgccgtagtagtcccgcttggcggtgatgtaggcgatgaccatgcccagcaggccgccgatcagcgctccgatcagacccaggataatggagttccgcaggctgtcccagccctgctgcaaggcgcgggtgtactggtccagggtgagggtgtagtcgtagccccaggtcttgacgaaggaaccaaagaccactgtgccgtagaacaggatgatgaccgcggccaccaccaggcagacagcgaacaggggccatttgatatggggctcatcgatgagcttgcgggcctgggtgggcttgcccgtgacggtgacgaaactctttttgttgacccagtatttgttcagcagataggccagcatggtaggcaccagcatcaaaagcgccagcacggagcccttctgcatgtcatagctgccggtgatggtttgatagacttccacagataaggtggtgaaatcgccgccgatggtggcgggattggagaagtcctccagagactggatgaacaccagcaggcagccggagatgatgcccggcagggacagcggaaaggtgaccgtccagaaggtgtgccaccggctggcgcccatgttgcaggcggcgtcctccaccgatgcgtcgatggaggagaggatgccggagagggtcatataggcgatggggaagaaactcagcacctgcaccacgatcaggctgcccatgccgtagacgtcgttgtccgtgatcttcagcagcccgttggtaatcagcccctgccgcccgaacagaaagatgatggacaggcacagaatgaagggcggggacaggatgggcagggtggcgatggtcttcagaaagcccttgcaggggacgtttgtgcgggtgatggtataggcgaagatgtagccgatgaaggtggcgatcactgccacgatcactcccagcaccatggtgcggccgaacgtctttaaataccgggaggtggaaaagatctccgccgcggtagccagggagaaagtcccggacgcatcggtcaggctgaagagcagaatcttcaccaggggatagatgacgaataaaagcaggagcacgatgaccgtaaggatcgagatcagcatgatgggctgacgcatgatcatcttggattcgttccgccttttcaggcgggcggcgcttttgccgcccgaaccagcagcgtttgccatttgggttcctcctgttgattttcaagcgtttggcaagaggacttcctccccgccggggaggaagtcctgcaggcatagagagaatcttccggaattactccagattttcagagctggcgatgttcgcctcgaactgcgcgacgaactcgtccttgtgctcggcagcccagacggcatcatagtcgatgacggccacggagtccagcgtcaccagaccctcggccggagtggcctgggagttggtgggcacccggaaggaattgttctcggcatacaggttctgaccctctgcagagcacatgaagtcgatgaacttcttggcgttttcctgctcgtcagcgggaccgcccttgatcagggccatggcacccacctcatagccggtgccgtcggtggggaaggacagctcgatgggatagccctcggtggtgggctgcagaccgtcgtgagagaaggtcagggcaatggccgcctcgcccagggccacgccgttgggagcggcggaaccggacttggtgtactgggacatgttcttgtccagctccttcaggtaatcccacacggcatcctcacccttcagctggatcagcgtggccagaacggtgtaggcggtgccggaggtggcggggtgggccataatgatcatatcctgatacttgggatccagcaggtcatcccagctggtgggataatcataccctttgtccgcgaaccagtccttgttgcaggcgaaggcgatggcgcccacatagatggggttccacacgccgtcggggtccagatagttctccggggtgttggacagctcgggggactgataggcctccagcaggccctggttggaggcggcgatgtagttgtcggtggagccgccgaacatcagggaggcctggggattgtccttctcagcagccacgcgggtcagcatctcaccggcggagagccgcagagcgttgaccttgatgccggtggcctcctcaaacgcgttgaagtagtaggccacctcggcctcggggaatgccgtgtagacggtcagctcgttgctgccgctggactccccaccgtccccttcggaggaggtgtcactgttgccgccgccgcaggcggtgagcattcccagcgtcatagccagggtaaggagcagcgcgaatagacgtttgctctgtttcataagagtgtctccttttcaccaattttaggttccggatcctccgggattttagggatattgtagcatctccggaaaagagtgtcaataattggtaacgtttgcacacaggagaaaccccataaggcaaagacaaaaatagaaaaaatgtatttgtataagagacaaaaatggcggcggcgctggctttttccggaagttttgttaaaaagcggaaggggaaattggtgaaactataaaatttatgacagcgcttactttcaaacacgtgcccttcaaaaccgtttcgtatccccgggacccggctggactgaaattgcccaaatttttctccaggctttaggcaatcagccgaagatttccgccaaagtgtggaagatattgacttctcttccggcttgtgataaacataaaagaaacaatttgggcgctttgggttcgtcgaaatttgtcaagaatgctgagaatggcgccgttcaaacagctttatttaaccatgcaaccgtttccgggaatatgcggcaacatctgccgcagaggtgacctgccgaaagagaggggagagttggcggagccattcctcccctttttattgtttgactgcccggcgcggggcggagagaggagtgtgcacagaatgatggaaggactggcatacctgcgggagatgaacgtggcctccgtcctgctgcgcctgactgtggccatgctcttcgggggcttcatcggactggagcgggagcggaagcgccggccggcaggcttccggacctatatgctggtatgcttgggcgcggcgctgaccatgctgctcagtcagtatgagagctatatggtgacccacgcctggcatgagaccgccatggagatcggcctgcggacggatgtgtcccgcttcggcgcccaggtcatcaacggcatcggctttctgggtgcgggcaccatcatcgtcaccggcaagcaggaggtgaagggactgaccacggcggcgggcctttgggcgtccgcctgtatgggtctggccatcggcgcgggattttacgagtgcgtacttttgggcttcctgctgatcctgctgaccaaccggctgctgcccttcgtggaggatgccatcatcgaaagcgcccggaacatgaacatctatgtggaattccagacgctggacaatctgggggacatcattgcccgcatcaagtctcagggcggacagatttacgaagtggatctggaccggggccgggaggagcggtccaagaatcccagcgcggtgttctccattcggctgcccggcaggcactaccacgtccgggtcctggcggcgatctccgagttggagagcgtctacaccattgatgaaatctgagggaggtgcggagattgctgccgatttttgacggtgtgcgggatgtgaccgtgctgtccaccacgctgcggatgctgctggcggtggtgtgcggcggtctcatcgggctggagcgggagtacaagcgccggccggcggggttccgcacccatatcctgatctgcctgggggcggccatgacgaccctcaccagccagttcctttatttgaacctccattactacacggacatggcccggctgggagcccaggtggtggcgggcattggcttcatcggcgcaggcgccatcatcgtcacccggcgccgccgggtgaaggggctcactacggcggcgggcctctgggcggcggccattgtgggcctgtgcctgggcggcgggttctacgagggcggcatcttcgccacggcgctgattctggcggcggagatgttcctgtccaagctggagtaccggatgctggacaacgccccggaggtgaacctctatatggagtacagtaacaagacctgcctggacaatgtgctgcggctgttccgggatttgaacctgaaggtgctgaacatggagattacccgctctacggagacggagacgcacaatgcctgcgccctctttaccctgcggctgaacaagcggtgccgggtggagcagctgatccccaagatgaacgccacggagggcgtggtgtcggtagaggagttgtaacagcggcgcaagccggaagaataggagagagactatgaaaaaacgtatgacgtactggtgatcggcccggtgtccctggatcacaacatcgactatcagggcaacgaacgcaaggaggtgggcggcgccgtggtggcctccggctttgcggctgccaaaagcggcaaccgcaccgccgtgtttaccaagctgaatcccgcggatgcggatgtggaggagcggttcgccgggtccggtgcggatgtgtactggaagccgtctcaggccacctgctccatccgcaaccagtatttcaccgccgacaaagaaaagcgggcctgcacctccatgggggtgtgcgatcccttccggttcgatgagctgccggatatcgagaccaagatctatcacttcgccggcctggtgtacggcgacttcgacggtgccctctttgccgaggcagccaggcacggcaaggtggcggtggatgtccagtgcctgctgcgccatgtggaggcggacaggaccatggccttccacgactgggcggaaaagaagcagtacctgccggtgatcgactacctcaagaccgacgcggcggaggcggagatcctgacgggcctcaccgatcgggcggaggccgccaagctcctgcacagctggggcgccaaggaggtcctcatcacccacaacaccgaggtgctggcctacgacggggtgaccacctacacctgtcccatcaaggcacggaacctctccggccggaccgggcggggcgacaccaccttcgccggctatatctcggagcgccagcgggccggggtggaggaggccctgcggtactgcacggccctggtctctctgaagatggagacgccgggccccttccagggcacccgacaggatgtgctggattatatccgggagttttattgagaaggcacaggagccgtccgcagacagcggacggctcctgtacaaaaactccattgacaacgggtattgtccgtgataaggtaacaagtgtcaattatataaaggcaaacgaagtccctagagaaacggcgcaagcctgccgaaggagtgaaactctcaggtgtcccggcacgggatgaggactagggatggatgtggctctggagaagctcagatgagtaccgaaggtgcaaggcgggaaatcccgctgaatctctcaggtaaaaggacagagtaaagggcaggcccttccgcacagcggagggggccggcgctttgttgggctgggcagggtctgtccggcccttttcgtttgcggacaaggagagagaaaacatggacatggatctgttggccgcaaaggtcagcgaactggccggctttgtgtggaacggcctgctgctgtatctgctggtgggtaccggcatcatcttcaccatccgcacccggttcatccaggtgcgcaaattcggcgccggcttccggcggctgttcggcagcgtgaacctcaacggcgagaaggccggcaaggagggcatgagctccttccaggcggtggcaacctctatcgccgcccaggtgggcacaggcaacatcaccggctgcgccaccgccatgatctccggcggccccggcgccatcttctggatgtggctggcggccttcttcggcatggccaccatctacggcgaggcggtgctggcccagaccttcaagaccaaggacgagacggggcacgtcatcggcggacccgtctactacatccggcaggcattcaaggggaccttcggcaagatcctagcgggcttcttcgcgctggctatcatcttcgccctgggcttcaccggcaacatggtccagtccaacgccatcagcaacgccttccaggaggcgctgggcatccccacctggatcgtgggcgtggtgctggcggtggtggccgccttcatcttcctgggcggcgtcacccgcattgccgccgtcacggagaagctggtgcctgtcatggcctgcttctatctggtgggcggcctcgtcatgctgattgccaatattaccaacctgcctcacgcctttgccctgatttttgagggtgccttcaacccccaggccatcctgggcggcgccgtgggtatcggcgtgcgggaggccatgcgctacggcgtggcccggggcctgttctccaacgaggcaggcatgggttctaccccccacgcccacgccatggccaaggtggaaaagccccaggaccagggcgttgtggccatggtttgtgtgtttatcgacacctttgtggtcctgaccataaccgccctggtgatgattaccagcggcgcgctgaacgtgggcgacatggctgccaatccggcggcggagaacatggcccaggtggcgttttccactgtgttcggcagcttcggcaatttctatgtggccatctgcctgctgttctttgccttctctaccatcatcggctggtacttcttcggcgagcagaacgtgaagtatctattcggtgtgaaggctgtcaaggtctacgcctgcattgcggtggtgtgcgtggccctggggctgtgctggaggctcccctggtctggaacctctccgacctgttcaatgcgctgatggtgttccccaacctgctggcgctgctggccctcagcgggctggtagccaaggcggccaggggaggggacgccctgcgcaaataagcgccccgcccagaaagagaccctccacccgaagttccgggcggagggtctcttcaagcatcccgggcggggagggccggaccgccctggccgtaggggagggtgaagaccgggatgccctccatggccggggcgatggcgtacatgggataaaaaaacgacagaccctccgccgtaagatagaagttctgcgggttgaaatggcgccgcagcagccggcggacgccctcatggtaccgggagatcccagccgtctcctgccgctggatctccgcctccgctgcctccatcagccgccgcttccatccgctgcggcggggaaagaaggcggacagaggcaccggatagccggaggtcagatcccaggtatccccatggcgcagaagcgtggggcgccctgaaaagccgctctcccgggactgggtatacaggctccagaggccgccgtcgttgtaggtgacctgataggtcagctccgcccggaagtggggcaggggcaggctggccgccagagcagcgcggtattcctccgccgccgcaggcaggaggtacgtctcacaatagcgtaggaaggaacggcactggagctggtaataccgccggatgcggcgggagactttgtccgctgctggaactggttccggcagggagatggaggcggagagcacagggatctcctctacggtccattcccgctccgcggtcatggcctctgcgtgcagctgggtgagaggttcgttcataggcgccgctccttccgaaaagatgctgttctgcaccagcctatgccctgccgccgggcggggtgactggacacgctttaaagtgcaagaaattttttctgtccggagccctttactttcacgcggcagagtgttaaaatacatcttggcggcgaagcgccgcaaatctgttggagcctcccagaaagggtactggatatggtaaagatcggcaagaaggaaaagaacggcgagctgtacaaggcaattctgctgctgaaggacgagcaggagtgctatgagttcttccaggatctgtgtaccgtgtcggagctgcgggccatggagcagcggttcgaggtagcctccctgctggacgacggcatgatctataacgagatcctggagcgcaccggcgcctccagcgccaccatcagccgggtgaaccggtccctcagctacggcaccggggcctacgagaagattttcgcccggtacaagaagcgggacaaatgagcagttatgacgccctggccgccagctacgatgccctgacagtggatgtggaataccgccggcgggcagactacctgacgcggcagttccacagaagcgccctcccggtggagacggtgctggacctggcctgcggaaccggcaccatggcctgcctgctggcggagcggggataccggatgatcgccgtggacggatccgaggagatgttgacccaggcggcctggaaggcggcggcgttggagcagccgccgatgttcctgcaccagtccatgccccgcctgcacctgggcatggaggtggatgcggcgatctccaccctggacgcgctgaactacctcacccggacggcagacctgcgggagacgctgcggcgggtataccgctggctgcggcccggcggactgttcctattcgatgtgaacaccccctacaagctccggcggatggacgggcaggtctatctggacgagacagaggacagctactgcgtctggcggaccttctacgcccccggccggaagatctgcacctatcaggtggacctgttccggctgaacgccaacgggagctgggaccgggcctttgaggagcaccgggagcgggcctgggggcgggaggagctggagacgtatctgacggaggcgggcttcggcgctgtcaccgtcaccggcgacctcaccagccgtccaccggcggcggaggaggaccgctggattttccggtgtcaaaagccggtcagaccaagataaaacaggagtttgtacaatgagcgatcagttgatccgggccatctccaaggatggccatatcaaggccacggcagtttccacccgggcgctcacagagcgcgcccgtcagatccacaaggctctgcctgtggccacggcggcgctgggccggacgctggctgcggtctccatgatgggcaacgccctgaaggaggacggggccagcgtgacgctgcagatcaagggcggaggcccgctgggaacgctgctggcggtgtccgataaccagggcaacgtccggggaacggtggacaatcctgtcgtggacctgcctctgcggcccgacggcaagctggatgtgggggccgctgtgggccatgagggtacgttgacggtgatccgggacctgaacatgaaggagccctatgtgggcagcgtgagcctgttgggcggcgaaatcgcagaggacctggcggcctatttcgtggagtccgaacagatccccacggcttgcggcctgggggtgctggtagaccgggaccagagcgtgctggccgccggcgggtatctgatccagctgctgcccggcgccggcgaggatgtcatcgccaaggtggagggcagcctgatggccgcagggccggtgacgggacttttgcggaatgatccggacccggaggctatgctgcggcacgctctgtcggatttcgacctggagatcctggagaggagccccatcgagtaccgctgctactgcagccgggacaggatggagcgggccctcatcagcctggggccggaggaacttcaggccatgatcgacgagcagggcagcgcggacctcacctgccgcttctgtgacaatgtgcagcacttctccagagcagatctggaggccatggtccgggggctccagaaaaaaatgtaaaaaaattaaatttccagttgacagaccgggcgtctttgagtataataacttttgccgtctgaaatgagcggcaatcggggagcatagctcagctggttagagcacctgccttacaagcagggggtcactggttcgagtccagttgttcccaccaaagttatacatggcccggtagttcagttggttagaacgctagcctgtcacgctagaggtcgacggttcgagcccgttccgggtcgccatctcccacgagatggagttccatctcgtgggtccccttggggttgcaattcccctcccgcgccgtgcggcgcggaaaagatttgcccagatagctcagttggtagagcaggggactgaaaatccccgtgtcgctggttcgattccggctctgggcaccacttgcgggcatagctcatctggtagagcgccaccttgccaaggtggaggtagcgagttcgagcctcgttgcccgctccactgagaatgcccacacaagatcgtgtgggcattctcagtggaaaagaaaatttaaaaaagcagtggacatttcggttcaaactgcatataataaaatagaagcaacggtgacatagccaagtggtaaggcaagggtctgcaaaaccctgattccccggttcaaatccgggtgtcacctccagaaaaacaaccacatcgaaaagatgtggttgtttttttgtctaaatgcattcatgggcgcaggggattggattccgcctgtgcccgcttttctttttcagcggaaccatccgcacggcggaaaggctctgccccgcaatcggaccgcaaagaatacggctccgctcgcctatgcgattcgattgcggggacgtgtgcctgcggatgctgctttgacgaaaatggatgggaagatggcggacttttttggggaaaaagatagctaaaacggcgaattctttacgaaaaatatacaagagcctgtgagaaaaacgtgctataatgagttcgaataaacagagatgtgggagaccagcccccgatccgccggcgcgccctccaggctgccgtacgggtctggggcgttttccctagaaggagtgtatatggcacatatcaattcggatattctgcgcctcggcgtggatgtggggtccaccaccgtcaaagcagtggccctggacccggctgacaacagcgtactgttcacccgctatcagcggcataacgcccatcaggcggataccgtccggcagctgctggaggaggcggccggtcactttcccggcatgcggttccgtatcggcgtgtgcgggtccggcggacggcccattgccgccgccctgggggcctgctatgtccaggaggtggtggccaacgcggcggcagtccgggccttgtatccggaggtccgcaccgcggtggaactgggcggacaggatgccaaggtgatcttcttccgctatgacgaggccagcggaaagctccagacctccgacatgcggatgaacggcagctgcgccggaggcaccggcgcgtttatcgatgagatcgccgcgctgctgaacgtgccggcggacgagttcgagcaactggctgcccgcgggaagaccgtttacagcatctccggccgctgcggcgtgtttgccaagacagacatccagcccttgctgatccagggggcggagcgggcggatatcgcgctttccaccttccacgccatcgccaagcagaccatcggcggcctgtcccagggactggagctgacggcccccatcatctttgagggcggcccgctgaccttcaaccccacgctggtgcgggtgtttgcggagcggctgaatctggaggaaagggatatcgttcgaccggaccacccggagaccatcgtggcccggggcaccgccatcgccatcgacgagctgttccccggacaggaggacgccatgaccctggcagaggccatggagcggctggacaaggccccggcccagaccgaagggccctccggcaccggcaggcccttctttgccagcgacgaggagcgggaggtctttctccgccgccaccgggcggagctgcgccagccggtggatgccgcggagcggaaggtcctgcgggggtacatcggcatcgactccggctctaccacctccaagttcgtctttatagacgagaacgagcaggtgacggacactttctacgccaacaaccagggggagccgctgaaggtggtccgggagggcctgctggccctggcggagaagtatgagaagctgggcatccagctggaggtgctgggcctgggcaccaccggctacggcgagcagatgctctctgctgcctttcacgccgactaccacacagtagagaccgtggcccacgcccggggctgccgccgcttcttcccggacgccacgtttctgctggacatcggcggccaggacatgaaggccatctggctgaaggacggcgtggtcacgaacatcatgctgaacgaggcatgctcctccggctgcggctcctttttggagaacttcgccgccaccctggggatgccggtggaccaggtggcggacgccgccttccgatctcaggcccctgccgagctgggcagccggtgcactgtgttcatgaacagcaccatcatcaacgagcagcgcaacggcaagcagcctgacgacctgatggcggggctgtgccgctccatcatcgagaacgtgtttacaaaggtggtccgcatcgccaacgtggcggagctgggggatcgggtagtggtccaggggggcaccttccggaacttcgccgtcctgcgggccctggaggagtatctgggccgggacgtgaccctggccccctatcccggcgagatgggcgctctgggtgcggctctcgcggtgaagcaggaggtggaggcccacggctacgccaacggccgctgctccgccttcatcggctttgacgcggtgaaaaacttccaatacacccgggagagcggtgtactctgcccccactgcaccaaccactgcagccggacgatcctgcatttcccggacggtggctgctatgtcaccggcaaccggtgcgaccggggcgccgttgtgatggaggcggcacctgcccataaggcccaggaagtgccggacctgttccggctgcggcaggagctgctgttcaagacatatccggtatcccccgtgcgggaggagcagagccagaccgtgggcctgccccgggtgctggagttctgggacagcatgcccttctggagtaccttcttccgggctctgggatatcgggtgaagttctcccatcccagcagccgcagacagtatgagagcggactgcagtacgtggcgtcggacaccatctgttttccggccaagctggtccacggccatgtgctggacctgtccaaacagggcgtagaccggattttcctgccctatatcctccacatgcccacagagaacaaaggggagaagagcccctacgtctgcccggtcatcatgggctactccatggtggtgcggaacttccagtcccccggggagcacttctccgtgggctttgagacgccggtgttccactggttcagcaagcaggaccggaagcggcagatctgccggtatgccgtggaacactgcggcgccacaaagcggcaggcggaggccgcttaccgtcaggcggagacggccatcctctctttccgccatcagctggtggaggagggaaagcgggtcatcgcggacaccggaaaggcgggcggtttcgccgtggtgctggcgggacggccctatcacacagaccccctcatcaaccacgacctgtccgggatgttcacccgtcggggcatcccggtgctgacggtggatagcctgcccggactggagaaggcggacctgcgccggtcccgtgtggagatcaccaatgacttccacgcccggatgctctccggcgccatggtgacagcggagcagccctgcctggagtacgtgcagatcgtcagctttggctgcggccatgatgccattttgtccgatgagatcatccgcctgctgggggagggcagcggcaagccgcccctgatcctgaaggtggatgagagcgaggccgccgggtctctcggcatccgggtccagtcctttattgagacggtacagctgcgccgctctgcccaggcggagcaggcggcctgccgcctgccggagccctacgcggtgaagtaccgcaaggaggaccggaagctgcggactgtgctggtgccaaatatctccgccccggtgtccactcttctcacggccttgatggaccgggagggtattcgggcggtgagcctgccggtgggcggcgtggagcagatccgggtggggaagaagtacacccacaatgacatctgcttcccctgtcagatggtcatcggcgagctgatcgacgccctgcagaagggaaactatccggaggactccgtggccgtgggcatggccaagctcagctgcgactgccggatggccaattacaccgcgattctgcgcaaggcgctggacagcgccggatttgaaaacgtccccatcctcaccacagaccctggcgacaccaagggtatccaccccggcgtgtccatgctgggggcccggtctgtgctgctggcggcgtgggccttctccatgctggacattctggaggagctgtgccggaagatccgcccctatgagacggcggcaggcgagacgaaccgcgtgttcagcgaatgtgtggagtggattgccgccgcatccaagcaggggctgggcaagatgatcggtgccttccggcgggccatcgaggcattccgggggctccgctatgaccgctcccgccgcaagccccgggtgctggtcaccggcgagctgctggtgaactttcatcccggcaccaacttccacgtggaggagtacctggaacgcaacgacatggaggtcatcctgccccgcatcacctaccagttccgcaaggacttccaggcggccatcagcgagatccgggacttcggtgcccatctggcgccctatcccttcgccctggacggcgccgtggagttcatccagcggtttttggagcgcattgcccggtcccatcccctgtatcacccggcggcccggcctcaggacctgtacagtgacgtggagcacttcatccccaagaccctcacctgcggcgagggctggctgatggcgggcgagatcgcccactacgcccaccagggggtccggtccttcatcatcctccagccctttgggtgcctgcccaaccacgtgtgcggccggggcgtcaccaagcggctcaaggaggagttccccggcgtgcagatcctgcccctggacctggatccggacaccagctacgccaatgtggagaaccggctccagatgctcatcatgaatcagaccgcggaggcggagcattccgcagctagtgtggaaccggcaccccaaaagacccggggcggttcgccccgtccggcgctgtcctctacataagcgcgggcgtcggctgtattttcagactccggagaggaatgcccggtgccgaggttcgacctggatacaaagaaggcagccgttcatgcgaacggctgccttcttgaattttcggttatcgggaatctcgggcatttctggaggcgcggaccggtcggcggtcacttcgcacgtgcaggaggcgtgcgggcgcttctatggacagtggagagcagctcccgcacctgctcccgggagaggcggggcggaagcgtgctgtacaagctccgctccacatcgtccaccagaatgctgtaccgagcctgcatgggcgcatccaacgcgtcccggaggggcccccctgccagacgttccagatactcccggggggtctcctggctttgacggcggcagcggcggcgggcgccccagtgctccagttccaggagggcggcacggggggttccggcgtaccgcagcagaaatgccctgacccgcaggcgctggcccagccgggagagcaggccacggcggcccagacgctgcctgacgagcccgtcgtcatcatcctcctccggcaatctgatgcggctgcggctgcgccagagccagcgcaccagagcagccactccggccaggaccagcgcggccagggacaggagcagcaacgccgtcaccagctgaggggcgatggcggggccggaggcgctttccacaggcagagcggcctcactgccgcctccggcggcggaggacatccctgcggacccggcggagcggccctggaagagagacgtcaggaaccggaatacagcggtcagggcgccctccagaaggctgccgacggcctgaaagatggggatcagctcccccctggcggccagcagcagagcgcaggcggccacagccagcacggccaggaccgctgggaccagcagggccgggagccgcccgaagggagaaccggcccgaatggtgttgcgtccggaggtgcgcatccccaccactgccagcagatccagcgccagcagcgccaacagaaccggcacccggtccagcagctgaggggcgaaggaggccacgatcagatagaacagcccatacaggcccatgtactccccggccccgtggaggtggcggaccgtgacaggcgtgacgccccagtggtatccccggcacagggggaagaggtacaggggcacctgaatcaccagaagaggcggataggtcaggtccagcgtgcggctgagcagggggatccagacggcgcagagaagaacgttcagcagcagaatctgccaaaagcggcggggcttttggagaaagaggctgttgcctgcggtcatcagcccgccagagagcagaaacccccacatggagaagggcggccggccacacaggagctgccacagaatatcggccgtcaggaagacaatcagcagctcggtggccagcggcaggcacttgagggcggtggtctttccatgtctcataggccgcctcctgcccgaaaagcattcaggtccaggacccgcaggagggggtgagactgttcccccaggccagcagggggacgcggtgccgctccagcagcgcacaggtaccggcgtccaggcggcggacatccccgcagatcagaaaggcgccggagagggtgcggaggcgcggcaggatctcgtccgccgtaatggagacagcggtgtctgcggcggccagcagcgtcaggactgcgggaagctgcagccggtcccggcaggtggcaaactgctccagccgcccggcggggcgggagatgagcagagacacggccacctcctcttccatcagctgcgccgccagggagcccaggatctccagggcagattcgaagtcctccggcggcaggcccgcgaaggaggcaccgtccagcaggaacgcggcccggcggggggagattttctcgtagatgttcaccatggcgccctgcccccgggccatcaggcggaagttcagggaccgggcgttgtcccccggctggtaggcgcggacgttccggatcacggtccggtcatcctgaaagccccgggcgccggtctccagctcccagctgttgcgcaggaaccagcgggtggacacggggaccagccggggaaacaccgccagcgtcacgggcctgggcagcgggatttccttctcccggacgcagaggcacaggccgtcgccggagagcagccggatccggtcaaaggacagcaggccccggtgctccgcctggaggcggctggtgtaggacatccgctgatgccccagcaggaaggagacgttcttttcataatagggcttctgcacgcccccctccgggagttccacggtctcccagcggtgctccggccggagggcgccgcccggctccagggggaagcgcaccgtcagccagaccaggggcagccacttggggttgtccagcgtcacccgcagaggacagggctccccggggaagacgcagctccgctccgcctggagggcggcgttcacgccgtccagcacatggcgggcccagaggcgggccgcggcggccacggcggcggccgccagagagaagatggcggcgggcagccgcccgctcaggctgaagcccactccgcaggctgccagggccaggatggagaagcgccccgtgaacaggctggactcggcgaagtccactgcagcggactcaggcgttctggccatgggcaaggacctccccggtctcccggcagggcacctgggccagtacggtctccaccacgccggccgcctccaggccggagagcgccgcctgatgggacagcagtacccggtggggcaggacgtagcgggccagatacttcacatcgtccggggtgacatagtcccggccggagagggcggcataggctttggaggcccggaacaggtcccgggacacccgggggctggcgccgcaggccagctccggctgctcccgggtggcctggaccagctccacgatgtacgccaccaccggatcggacaggcggacctgccggatctcccgggtgaaccgattgacttcctccggggagagcagggggcggaggtccgcaaaggcggctccatctcccacggttcggagcatggcggcctcctccctgggggtggggtagcccatggagagcttgaagaggaagcggtccagctgggcagcgggcagggcgaaggtggtctccgtctccacggggttctgggtggccaggaccatgaagggtggggccaggggataggtgacgccgtctacggacacctgccgttcctccatggcctccagcagggcggactgggtacgggggatggcccggttgatctcgtccgccagcaggatgttggtcatgatggggccgggggtgaagaccatctccccggttttctggctgtaaatgttcatgcccacgatgtctgagggcagcagatccggggtgaactgcacccgcaccatgccgcagcccagcaccgcggagagggccttcaccagcgtggtcttgcccacgccggggatatcgtcaatcagcacgtgcccgccggcaaacaggctggtgagtaccaggcggatctgctcacccttgccgatgatggccttgccgcactctgtctcgatctgctccgccaaatggcggagttccgtgaagtccatagtcgtgcctcccaggttccatgaaatacccctctattatatctaacccgaaagcggaccgcaagagcggatgccagctccgggaagacctgaaaaaatgcgtgaaaaggagggaaccctctggaaaagcggaagcgcctgtgctatgatacgaaacagaaggtcccgcaacaggaccgacgagaatttgggaggaatgcgtatgaagaagacattgtccctgctcctgtccctggtgctgatgctcagcctggcgctgcccgcatccgctgcggagacggagtaccccaccctggagggcggcgtaaccgagatccagaagtatggcaacatcgtcctggacatcgatccggcggacctgaaggacggcggctacacatacggcgacctgctgaccgtcaccgtcaacggcactgggtatgacatgcccctgtgcaccaactactccgatgtggacaccggcgcgctggtgctgcgggacagcgagggtgtgctgatcgccgccatcaacatgggggactttgcgaccagcaacggcctggccgccaaggtcaccgccgaggacggctcctacacctgggagttccccgagggccagtccctggagagcatcaccgtctccatctccatgaaggagcagggcggctactatgaccagtacctcatccaccagctgacccgcaccgacgagcgggcggactacgcctccgacgcggtgttcgccaacttccgcaacgtggctgtgggcgatctgggggagaacgcctttttccgcagcagcagccccgtgaacaacgagctgggccgcgcctcctatgccgatgacctggcagaggccggcggcatccaggcggtcatgaacctggcggattccaacgagctgatcgagggctacatcgccgccgagggcttcgactccccctactaccagtctctgtacgaggcggggaaggtgaaggccctgaacctgggcgtggacttcaccgctgccgacttcaagtccggcctggcggagggcctgcgcttcttcgcggagaatgaggggccctatctggtccactgcaccgagggcaaggaccgggccggctttgtctccgccctgctggagtgcctgatgggcgccacctatgacgaggttgtggcggactacatgaccacctatgtgaattactatcacctggaagaaggcggcgagcagtatgaggcggtgaagaacagcaacatcgtctccatcctcaccaacatcaccggcgctgcggagggcacggatctgaccactgtggatctggccgctgcggcagaggactatatgctggacgccggcctgaccgcagacgaggtgaccgccctgaaggcgaacctggctaaggactacacggtagagaccgaggctcccgcggaggagacgccggaggagcctgttccccaggcccagacctacaccgtggaggcgggagactgcctgtggaacatcgcctatgaggtgtacggcaccggcactcgctggactgtgatctacgaggccaaccgggataccatccgtgaccccggcatgatccacatcgggcaggtgctgaccatccccgctgcctgaaaatgcctgattcgtttttgaaaacagctcccggagcaatccgggagctgtttttttgcctttgtatgcgcttgcaaggattttacatagactttacagagtcctggtgtcggattttacttccggctgtttatactaagaccgtcccttgagcaacagacataggaaaaggagtaatcttcgatatgaaaaaagtattttcgctcttgctgtccctgaccatggtcatggctctgctggccggctgcggcggtgacaccacggctgacgacaccacggatgataccgcttccaacgacgccgcccaggaggagaccgctgagctgagcggcactgtggccaccgacggctccacctccatggaggaggtcatcggcgccctgggtgagcagtttatggccgacaactccggcgtgtccgtcacctacaaccccaccggttctggcgccggcatcgaggccgtgtccaacggcagctgcgacatcggcctggcctcccgcgcactgaccgatgacgagaaggcgggcggcttgactgagaccatcgtggccctggacggcatcgccgtgatcgtcaacgctgagaaccccgtctccgacctgaccctggagcagatcgcctccatctacaccggcgctgtcaccgattggtctgagttcggcagcgacgccggcgccatcgccgtgatcggccgtgagtccggctccggtacccgtgacggcttcgagtctatcaccggcactgaggaccagtgcgtgctggcccaggagctgagctctaccggcgccgtgatcgaggcggttcgtaccacccccggcgccatcggctatgcctccctctccgccgtgcaggatcagaagggcatcacggtcctgactgtgggcggcgtggctccctctgaggccacggtcctggacggcagctatgccattcagcgtcccttcgtgttcgccacccgcaccgatgaggccctgtcggacgcggcccaggccttcttcgacttcgccacctccaccgccgccagcgacctgatcgccaacgccggcgccgtgcccgtggcccagtaagacaacgcttgttttccaccctcatatatacggtcagccgccgtgcccaccactggggcggcggccgttccgctgaaatctggacggacgccttgtccgggaacaaaggagaaccttatggaacatgaaatcgcggggcaggctgtgaaggccgccatggacggcgcgctggtcggcaccgccgacaggaaaaaggagcccatgaccgggaaaaaagccctgaaggccatggagcgggtgatgaatgccctcttctttatctgcggcatggtggctgtggcgttcgtgctcctcatcagcatctaccttatcatctcgggcctgccggccattctggagatcgggcccatcaacttcctgttcgggacccgctggtatgcctctaccggagacttcggcatcttcgccatcatcctcacctccttcgcgggcacggcgggggccattctcgtgggggtgcccatcggcctgatgacggccattttcctgtccaaggtggcgccgcctaagtttgccgccgtagttcatgcggcagtggaactgctggccggcatcccctccgtggtgtacggcctggtgggtatgatcctgctggtgcccgccatccgggtggcctttgacctgccctccggcgccacgctcctggcggctatcatcgtgctggcggtgatgattctgccctctatcgtctccgtgtcggagacggcgctgcgcgccgtgccccgggagtatgaggaggcgtctctggccctgggggccacccatatcgagaccgtgttccgcgtcagcgtgcccgctgcccgcagcggcatcgccaccgccattgtgctgggcatcggccgggccatcggtgaggccatggccatcattatggtggcgggcaatgtggccaatatgccgggcctgctgacgccggtgcggtttttgaccaccgccattgcctcggagatgtcctacgcctccgtgggctccctccaccgcaatgccctgttctccatcggcctggtgctgttcctcttcatcatgctgatcaatgtgttcctcaacgtctttatcaagcggaaaaaggaggactgaccgaacatggaatctcataccctgtccccccggcgccagctgtacgacaagggcctgcgggtggtgctgtacttctgcggcttcctcacctgcgcgctgctggttctgatcatcggctatatcttctaccggggcgtcccattcatcagctgggagctgctgtctacccagtccagctatatcaacgacaccatcggtatcctgcccaatatcctcaacacgctctatatcatcctgctgtccatggtgatcgtgctgcccctgggcgtgggcgccgccatctatctgacggagtacgccaccaaccggcgtctggtggctgtcatcgagttcgccaccgagaccctcaccggcatcccctccatcatcttcggcctggtgggtatgctgttcttcatccagatgatgggattgaagaccggtgtgctggccggcggcctgaccctggtggtgatgatcctgcccaccatcgtccgcaccacccaggagagcctgaagaccgtgccggactcctaccgggagggcgccctggccatgggcgccggtaaatggcacatggtccgcactgtggtgctgcccaacgcggtggacggcatcgtcaccggctgcatcctggcggtgggccgcattgtgggcgagagcgcggcgctgctgtacaccgccggcttcggcctggtgctcaataactttgtgactgcgctggaatcctcctccgccacattgaccgtggccctgtatgtgtatgccagtgagcggggcgagacagacatcgccttcgccatcgccaccattttgatgctgctgacgctggtcatcaacctgtccgccaatctggtgggccggaagctgaagaaaaactgacgaggaggatacgaaatgtccaccatcattcaagtaaaggacctgaatctgtggtacggggcgcaccatgccctccacggtgtgaatatcgacattccggagcatgagatcaccgccctgatcggcccctccggctgcggaaagtccacctttctgaagaccctgaaccggatgaatgacctggtaccgggcatccgcattgagggggaggtcaactacgccgggcagaacatctacgcccccaatgtggacaccacctggctgcgcaagcagatcggcatggtgttccagaaggccaatcccttccctatgagcatctatgacaacgtggcctacggcccccggacccacggcatccgctcccgggccaagctggacgagatcgtggagaactctctccgctccgccgccatctgggacgaggtgaaggaccggctgaagaagagtgccctgggcctctccggcggccagcagcagcggctgtgcattgcccgtgccttggcagtggagccggagatcctgctgatggatgagtccaccagcgccctggaccccatctccacctccaagatcgaagaccttgcagtggaactgaaaagcaagtatactgtcatcatggtgacccacaatatgcagcaggccgcccgtgtctccgacaacacggcgtttttcctgctgggggatctggtggagttcggcaggacggagacactgttctccacccccacggacaagcgcacagaagactacatcaccggccggttcggctaaggagggacgtaaggtgagaaacagatttggcgagcagctggagcggctgcacgtggaaatgatccagatgggcgccctgtgtgaggatgccatctctgccgcggcccaggccctgatgaagggtgacgaggacctggcacgcgccgccggggaggcggagcgggagatcgaccagaaggagcgggaggtggagaacctctgcctgaagctgctgctgcagcagcagcccgtggcacgggacctgcgggagatctcctctgcgctgaagatgatttccgatctggaacggatcggggaccaggcggcggacatcgcggagctgacccggttcgtgcgtctgccggacggccccggccgccagcggatcgaggagatgtccaaggccgtcatccggatggtgacagacagtgtggactcctttgtaaagcgggatctggagctggcccgggaggtctgccgggaagacgaccaggtggacgacctgttcaaccaggtgaaaaaggagctgatcgggctgatcgccgcagacgccgactccggcgagctgtggctggatctcatcatggtggccaagtatctggagcggatcggcgatcacgccaccaacgtggcggagtgggtggagtactccattacggggaatcacccctccaacaactgagcggcctgcgcacaggcgcggcgccgatattgaaaagggggaggggccatgcttacctatgaggatgtgaaaaacaattctgcggtccggacctatatccagagggcggacgagtctctgaccgctctgggctatacggagcacagctttgcccacgtgacggcggtggcggaaaacgccgcctatatcctctccaccctggggtatccggagcggacggtggagctggcaaagatcgccgggtttcttcacgacatcggcaacctggtgaaccgggtggatcactcccagtccggtgcggtcatggccttccgcattctggacaacatggattgtcctccggaggagatcgccaccatcgtcaccgccatcggcaaccacgacgagggcaccggcatgccggtgaacgccgtggcggcggcactgatcctggcggacaagtccgacgtccgccgcagccgggtccggaatccggatatggccagcttcgacatccatgaccgggtgaactactcggtgaagaagtccgtcctgaagatcaacgaggagcacacgctcatcaagctgaagctgtccgtggacacgaagtacggctctgtcatggactattttgagatcttcatgggccggatgctcctctgtcgaaaggcagcggagaagctgggcctgcagttcaagctgatgattaacgagcagcagctgatctgaccggccgccggagggagacaccctccgtccctccagcggggcggagagattgaatggggagggatatctgtgatctatctgctggaggatgacgacagtatccgggattttgtgatctatacattgaacagccagggtatggaggccaggggctttccgctgccctccctgttctggcaggccgtgggagagcagatgcctgccctggtgctgctggatatcatgctgccggaggaggatggactcagcgtcctgaaaaagctccgggccacgccccgcacggccaagctgccggtcatcatgctgacggccaagggcacggagtacgacaaggtggtgggtctggacggcggcgccgatgactatgtggccaagcccttcggcatgatggagctgctctcccgcatccgggcgctgctgcggcggacggagacggagaacggcaccctccgctgcggcattctggaggtggatccggggcagcacatcgtccgggtccggggacaggagaccatcctgacccagaaggagtttgaagtgctgtgcctgctgctgcgcaaccccggccaggtgctttcccgggagcagctgatcgagaacgtctggggctacgcctttaccggcgagagccggaccgtggacgtccacgtgcggaccctccgccagaagctgggagaggcgggcgtttacatcgagacggtccggggctatggctacaagatcagccctgtgaactgacaggagggctggagagacatgacgaaacggatctttcgctccatcctgggcgtgtccctggcagtgctgctggccagcctggtgctgatcgtgggcgtgctccacggttatttccaggatcgggtctccggtgagctggagagtctggcagagtacatcgcccatggggtagaggagaatggcacggactatctcacagaggatctgcccggcagctaccggattacctgggtggatgcggacggcaccgtgctcttcgacaaccggcaggacccggaggagatggggaaccacgcccagcgggaggagatccgggaggcgctgatcctggggaagggacatgcggtccgctattcggacacgctttcccagcagacgctgtatgcggcccagcggcttgctgacggaacggtgctgcgggtgtccagcgcccagtattccgtctgggtcctggtactgcaggcgctgcagccggtggcgctgatgatgctgctggccttcatcctggccatggcgctggcttcccgggtggcgcggcagctggtggagcccatcaacgccatcgacctcaatgaccccgccggcagcgagacctatgaggagctgacgcccctgctgtccaagctccgcagccagcagaggcagatccagcggcagatgcgggatttaaagcgccggcaggaggagttcaccgccatcacggagaacatgagcgagggcttcctggtgatcgaccaggagacgcgggtgctgacttacaattccgccgtgctgcggctgctctacgcgcaggtccccacagaggagggagagagcgtctacgccctgaaccgggaggcgggcttccgccgctgcgtggaggaggctctggccggtcggcggtgtgagcagctgctggaaaaggacgatgattgccgccagatcatcgccagtcctgtggaacaggacggccagatcgcgggtgcggtgctggtgatcctggatgtgacggagaaggagcagcgggagcggctgcggcgggagttcaccgccaacgtctcccacgagctgaagacgcccttgacctccatcctgggtacggcggagatcctgcagaacggtttggtgaagccggaggacgtcccccacttcgccgggaacatccaccgggagacggagcggctcatcgggctggtgaacgacatcatcaagctgtcccgcctggacgagggcggcggcctgggccagtgggagaccgtggatctgtacgaggaggcgcgagccgtcctggagcagctggctccggcggcccagcggaaacaggtgaccacccggctccagggcggcgaggctctggtgcggggcgtaccccagatcgtggaggagatcgtctacaacctctgcgacaacgccatcgcctacaaccgggcgaacggcagcgtcaccgtcacggtggaaaataccgccttcggcccccggatcacggtggcggacaccggcatcggcattccccgggaggcccagggccgggtattcgagcggttttaccgggtggacaagagccattcctccggcggcacgggactggggctctccatcgtcaagcacggggcggcctatctgggtgcccaggtggagctccacagcgaaccgggccacggcagcacctttacgcttacctttccgaaggcgggagcatgagggggggcttgcaatcccggcggaagtgtgctaggataaccggagattgatgaatgattggaggggtgtgaagatgcggatctgaccttcgtgttttggcatagagggttgctgcggcgaagacgcagcgtctttttccatgccattgcagggaaggcagaccgctgatctcacccaggtatcgcacagccccggatgcggggtgaatgccgtatgcccggccgcgggagaggtctgctctcccgcggccgttttttgctgcgcaaaagcacggcgaatcggaaatgacggatgagacgctcatgtgcgcggcatttgccgaagtctgcggtgcgccagaccgcacatgagggtctgcgcaaaggaggaatgcgatatgtccatgatcgacgtctcgaatctgacatttggatacgagggcagtccggagctcatctttgaccatgtgggctttcagatcgatagcggctggaaattgggctttaccgggcggaacggccggggaaagaccaccttcctgcggctgctccagggggagtacccgtacagcggcaccatctccgcctctgtggaatttgagtacttcccctacgaggtggcgaacctgtcccggacgggcctggaggtggtgcgggagatcgcgccggaggcggaggactgggagatccagcgggagctggggcttctggacctggcagagagatcactggagctgcccttttccagcctctccaacggggagcggaccaaggtgctgctggcggccatgtttttgaaggagaatgccttcttgctgatcgacgagcccaccaaccatctggacctggagggacggcggaagctggggagctatctggcccggaagcggggatttctgctggtatcccatgaccgggcgttcctggaccagtgtgtggaccatattctggccatcaaccggaccaatattgagatccagcgggggaatttctcctcctggtgggagaaccgccggaggcaggacgcctttgaactggcccggcaggagaagctgcagaaggacatcgggcggctgacggagtccgcccgccgtgcctccggctggtcggaccggacggagaagagcaagttcggtgtggacaagaccggggccaaggcagcggaccggggctttgtgggccacaaggcggccaagctgatgcagcggtccaaatccatccagcgccgccgggaggaggcagtggaggagaagaagcagctgctgcagaacctggagcggcaggaggcgctggcggttacgcccctgccctgccggacgggtgcgcggctggcggagttccgggacgtagccgtgtgctacaacggtcgcagggtctgccgggagatcaccttcgaggtgctggcgggggagcggatcgccctccagggcgcaaacggctgcggcaagtccagcctgctgaagctgctgctgggggaagagatcccccacagcggcacggtggagaccatgagcggcctggtggtgtcctatgtcagccagaatacggaccacctgcggggcagcctgacggagtttgtccggacccagggtctggacggcagccggttccggaccatcctgcggaagctggatgttccacgggagcagtttgagaaggacctggcagattacagcagcggccagaagaaaaaggtgctgctggccgcaagcctctgcacacaggcacacctgtacgtgtgggatgagccgctgaactttatcgacgtcatctcccggatgcaggtggaggatctgctgctggcctgtcggccgaccctgctgttcgtggagcacgacgcccgcttctgcgacgagatcgccacccggcgcatccggatccagagggaatgactcgaaacaagaagacgccctccgcagttgtgcggagggcgtccgttttcctttgtgattaccagaggtcgggccagaatacctggccgtcctccgaccggaagggctcgggcaccgtgtcctcttccagcatccgggcccggatggcggcggagaggtcctccactgtgccggggccgtagtcggcaaaggacgccgagtccatcaaaatggcgcccgcccgggccatgtcctccagattcacccgctggatctcctcggtatgggaggagcagcagtccgtcagcaccacggtgttgtactccagagcgatggcgtcatagcaggtggtgcggatgcagttgggggtggtggtgccggtgaggatcaccgtccgcacgtccagccgccggaggatcaggtccagctccgtctggaaaaaggcgctccacctgggcttgatgatggtgtagtccccgggctgggggcgcaggccctccggtgcctgggcgctgttgggaccggtggaggcggggcggcaggcccggccgccagcgacccagccggggtaacgggtcagctccacatcgctgccgtcagcgcggtagagccgcttgacaaagaataccggaatgcccttggcccgggccagctccacggcccggacgcagttggggaccatggactgggcgaagcggatccagtgtccgccctccggatgaacaaagccgttttccatatcgatgaccagcagggcggagcgggtgggattgggtttcatcagcagaacctcctgtcagagtttttgaaaaatatggatgcgaaaggagatacgggtggtgagagactccaggtccgccagacgctttgcacctgtcttgggggtcttccagtaatagggcgtcatctggaacagggcgcggatgtctgcctggcaggggagggtgatggtgccctccaccggcacgatggactgataggcgaacccctcatagggggtctccttttcctcattgggatagggacggtcgtagaggacctgcttcagctcccagaggtggtccggtccgggcaccacgtagaggaagtgcccgcccggcctcagcactcgccggaattcctccagcgccaggggggagaagcagtccagcagaatgtccgccgcgccgtccgccgccggcaggtggaaggaggaggccacagcccacgcaatgcctttctcccgcttggcggcggatcggagaatgggcttggaaatgtcggttcccgccatccggggggattttcccgcggcggccagggtccggaagatgccggaggtgtagaatccctcgccgcagcccacgtcccagatcaccggcgattcgccggaaagagacaaaatctgacaacagagcgtattgagaagcaggtcataataccccttggagaggaaatcccgccgtgcggcggccatatcccggtcatcccccggcgcggcggagtgcttttgattggggggcagcagataggtgtagccctcccgggcgatgtcataactgtgtccggccgggcagcgataggcccggtctccgcggtccagcggcgccccgcagacggggcagcggaaaagactttccatcacgtgtcctcgcccgtcacatcgttgatccacttccggctccgcagccgcaggataccccaggggcacttgcacacattttccgactggatgcataggcacaccaccgctaccggggcgttgaacaccagggcagtcaggaaggtcagaggtacagcgatgacccactggcagctcaggtcgatgatggaggccatgcgggagtcgccgcccgcccgaagcaggccggtgatgttggtgatgtcaaaggccttcagcggcagcatgaagagatatacgacgcacatggtgacggcgatctccagcgccagcccctccaaatggaacagaggatagagataggggatgaacaccgtaggcaggaggaccgccaggcacaccgacaccacgagacccactccgaaggagaccgtcagcaggcagcagcccagagagtagacctcctcccggccggcgccctcaccgatccgcttgcccacaatcacggcggtggcgcctgcgatgccgaagcaggccacagtggagaacttgtcgatgttgcccatgatggcgtgggccgccagcatatccgtgctgatggccatgtggcccatgacggcggtcataacgctgacgcccagaccccacagcacctcgttcaccagaacgggggtggcgtatttcaggaagctccgcgccatggccccgccgggccgcagcagcaggcggagcatcaggggcactcggcggtagcggggggcatagaccgcgacgatcacgaactccagcacccgggaggtcagggtggcaatggcagcaccggtgatccccagcgcaggcgcgccgaacttgccgaaaataagaatgtagttcaagcccgtgttggtcagcatggagatgccgaagacgatcatgcccatggcgggattctccgtgctgcgctgcatgccgatgtagacggagctgatggtgttgaagatatagctgaggccaacaatccggagatagggggcgcccaactcaatgagcaggtcgttgttggtcaccagagccatcacatggagggggaagaagaacagcacagcggccacggaaaccgcaatgatgagcccggcgtaaaggctgacgcccatacagcggttgatgctgtcggtgtcccccttgccccagtactggctggccaggacggagagtccgctgagcaggcccaggatgatgatctggagcaggtagatgggcgtgttggcggcagtgacagcggacagctcattctgccccagcatacccaccatgaaggtgtccacaaatcccagggaagtggtgatgagattctgcaggatcagcggcagagccagcaagaacagccgcttgtagaagccgggctcccgatgaagatgacgaaacataaaagacgaaacctcttgaaactgaaaagtaaaattgccttacagcatgggcatccgcgtgtcgtggtggcgccgcagggcgtccgcacaggcgtcgatgtcgcccttgtcagtctccgggccgaagctcaggcggatcaccccgccggagaccttcttggatagcttcaaggccgcgatcacgtgactgggcttgccctgatggcaggcggagccggcggagatgcagacgccctggctgcccaggtcattgacaatattttggctgggccagcccacgagagagatggagaggatatggggcgcgccgccgggagcggagaggattttcaagtcggggatggcagacagccgctctgcggcatagtcccggattttcgccatgcagaggagtttctcctccaaattttcccgccgcagctccacagccctggcaaagcccgcgatctgggccgtggcttcggtgccggcccggaggccgccctcctgcccgccgccggccagcagcggctttggattccggacccggggaccgatgtacagagcgccgatgcccttgggcccgccgatcttgtgggcggagatggtgaggaagtccgcccccagcgtttttgcggagcatgggaccttcaaaaagccttggaccgcgtcggtgtgcagcaacgtctgtgggttcttcaccgccaggccccgggcgatctcagcgatgggatagatgtttcccagctcgttgttcaccagcatgcaggacaccagcgccgtgtcctgccggacggcggcgaggacctgctccgcagagagggagccgtcctgagccgggacaagatacgtcacctcgtatccctgccgctccatccagcggcaggcttccagcacggcgctgtgctccactgcggtggtaacgatgtggcggcccaggtggcggttctgccagcaggcggcggtgacagcccagttgtccgcctccgtgccgcaggaggtgaagaacagctgcttggccccacagcccagtgcgtccgccacggtcttccgccagacttccacccggcgcttcatctccagccccatggggtactgggagctggggttgccgaactgttcggtgagcacctcatacatggcatccgccaccgcccggggaacgggcgtagtggcggcgtggtccagataaatcatgaaaaacgatctccttgcagttgggccttgcccaacagtaaaaattacagtataatcgaaacgcatcaagttattatataaaggttttgcggaaagtgcaaggagattccatgaaagttgccatctataccttgggctgcaaggtgaaccaatatgagactcaggccatggagcaggagctgctggcaagggggcacacgctcacggagttttccgatgaggcggatgcctatattgtgaacacctgctccgtcacggcagtcagcgaccagaagtcccggcaggtgatccacggcgtccagcggaagcaccccggcgccgtggtggcggtgtgcggctgctatccccagacccacgcggacgacgtgcggaagctgggggtggacctgatctccggcaccggcgaccggacgggttttatccgccttctggaagaggccgcggcggagaagcggcagatcgaggccatcgaccagccttttgagcggcgggtgttcgaggtcctgcccgccggcggcctggggggccgcacccgggccatgctgaaggtggaggacgggtgcgtcaacttctgtacctactgcatcattccatacgcccggggacgggtgcggtccctgcccgtccccactgccgtggagcagactcgggccctggcggcagagggctaccgggagatcgtggtgacgggcatcgagatctcctcctggggccaggacctgaagaacggagagaccctgatcgacctactggaggctgtctgcaccgccgcaccggctgtccgcatccggctggggagcctggagccccggaccatcacagaggagttctgccgccgggcggccgccctgccgaacctctgcccccagttccacttgtctatgcagtccggatgcgacgacaccctgaagcgaatgaaccggaaatacgataccactcgatatgcgcagtccgttgcacttttaaatcaatattttgaccaccccgctgtcaccacggacctcatcaccgggtttccggaggagacggaggaggaatttgcccagacgctggacttcatccgccggtgcggctttgcccagatgcacattttcccctactccgtccggcccggcaccccggcggccaagatgcgtcaggtgccgaaggccgtgaaggaagagcgggcccgccaggcggcggcggtggcggaggcgctccaccggaactatctcgcggcctgtgtgggagcggtgtatcccgtcctctttgaacagcccaaggacggcaggtatttcggccacgcacccaactatatggaggtgctggcggacgggacggacctgcataaccaggtgcggaatgtgaaagtcaccggcactgacggagcatccctgctgggtgagcttttggaggactgacatgaagagccatttctttgcctacatctcccggatgcggttcatccagcggtgggccctgatgcgcaacaccgcgccggagaacgtccaggagcacagtcatcaggtggccgtcctggcccacgctctggcggtgatccgcaacgagaagttcggcggccgcctggaccccggcgccgtggcggtggcggcgctgtaccatgacgccagcgagatcctgaccggcgacatgcccacccccatcaagtacgacaacccggccatccgaaacgcctacaaggacgtggaggcggtggcggagggcaagctgctccacatgctgccgccggagcttcagggggtgtacgggcccatcctgacgcagtccgacccggaggtgcggcaggtggtgaaggcggcggacaagctctccgcttatatcaagtgtgtagaggagctgaaagccggcaacaacgaattccggcaggccgccggccagacccggaaagccctggagggctacgaactgccggaagtgacgtactttctggagacctttatggacagcttctccctgaccctggacgagctgcagtgaacaaagaaccgccctggcgcacagcgccagggcggttctttgttcacttgttcagcttggagcagatcagcccgcccaggcggcggacaccctcctcgatcaggtcctccggcgtgttgccgaagctcatgcgcatacagttcttcccctggccgtcccggtcggagaagaagccctctcccgccacaaaagccacgttcacagccgggtctgtggaagactcctgcagcagggcggaggtgtcgatgccgccgggcagctccacccaggtgaagaggccgccgtccggattgctgtgcttggtaccggcggggaaataccggtcgatgctctggagcatcacgtcccggcgcctgcggtacaggtcgcagatcatctggtggtgggccgggtaacagccccgcttgaagaactccgcgcagaggatctggggcagcatggaggtgtgggagttggtggcggacttcacgtccaccagatgctggatggtctccgtatccgccaccacatagcccaggcgggagccgggggagaaaatcttggagaagctgcccgccatcaccacatggcctgtggtgtcgaagtgcttgatgggaggcaggtcctctccgctgtaccggatatcccgataggggtcgtcctccagcaccagcacgtcgtatttggcggccagctccgccacggccttccgccgctccaggctgagggtgcggccgctggggttctggaaggtgggaatgacatagatcatcttgggatggcactgccggatcttccgctccagatcctccgggatcaggccgttgtcatccatggccacacccacgcacctggcctcgaacatatcgaagatctccacggactggacgaaggtgggggcctccaccaggatcacgtcgccggggtcgatgtacgcctggcaggccaggttgatgccctccaggccgccggtgatgattatgacgttgtccacgccgcagtcgatgcccttgggagccagcagttcccggaccaccacctcccgcaggtcccggatcccctcaatggggccgtactgcagggcctccacgccccgggtgtccgtccgcagcacctcgtcggccagctggcggatggtgtccaccggcagggcctctctggcgggggaaccgccgctgaaggagatgatgtccgggttggtcatggacccgaacagtcctttgaccacattggccgtgaaggccattttttccatacgcttggcataaggcaccattctgcgctgtcctccatttcaagggcgcgcccttccggcgcgccgctgtgtgatttgatcgtttcagtataccacaccaggcgggaaaactcaattccccaaaaacaagccgtcccggggcaatgccccgggacgggaggatggtcattccaggggaatttggatgtctcccacctgcacggcggcgacctggctcacgtccagcagatgctggaaggagcaactgaaggacagagagaagggaagcgcctcgtcgggacggctgccggtgctgccgctgagtccgctccgggtcagctcctgtaccggcagggcattgccgtccgtcaggaccagggaggtggccgcccgcagatcttcgagaccctcataaacggtgttaccggtgagctgcacatggatggagaagggggacaggaccgtctggacaaagacaccgtcctgctggtaggaggccgtcagcgtctgggaggatcccgtcggctggaaagtcaccagggccggatggtctgtcacagcggtgtccacgccgtccacccgtaggacagggggcgtcagcagcaccgtcaccggctgggcggtgaagtcggcgctgccggatttcacggcgatatgaaagagataggtgagggtattggtctccatgtcatagccctggctctccgagccgccggagctgccgctggtgtagttgatcaggcggaaatccgccaaactgctcccagctctttccacgtagccgcaatatgaggtgtagtctgtccagtcgatgtccgcccacctgtcctggtcggcggccttcagctcctcccaggaaatgtcgccggtgagatagtaggagatatctggcaggtcgatacaatttgcctgccagtcctcgctttcataggccatctccacgagctcccggtccactgtgtccggcagccggtagtccagaatcagataaaggttcttctcggagaccagggcctcccggatggtcacggccacatcgtcgcagacggagatgacattcaccttctggaaggccttctccgccatgggggtttccgccgcgtcggggccaaagtagccggtgaaaatatcatcccagtccaccagcaccgctgcccccacggacagcgtcagtacaacagccagcaccgcagccagcagcgcctttcggaaaaatccccgggggcggtagacggcggtccgggcctgaggttccggctccgcggacaaaacagcctcccgcagctgttcctccagctccggcgggggcgcgcagtgttccattgactcgtgatagcgattcataagctctcctcccatgtgttccgcagggcgtcccggccccgcttcagccgcattttcaccgtgggcaccgtcacccccaggagccgcgcgatctcccggagggtgtagccctcgtagtagtggaggtgaaggactgtccgctgggactccggcagggcggccacgtggtccaacaggcccagctcctccggcgtgacggcggcggaggcggcctccagcggcagctcggaccggctggatcgcttccaggcgtcccgacactggttcagggccacccggaacagccatcgccgctcgtggtccggcgaggcaaagaccggcgcccggtacagccgcttgcagaacacctcctgcaagatatcctccgcatccgccgggttcttcatctggatcaggcagaatcggtacagggacggcccataggtccggtatacctgctcaaagagctgctccgcttcggtcactggcctcacctccttctgctgtgattacgagtgagcggggcaaaaggtcacaaagaactgcaaaaactccccggcttctgccggggagtttcagttcagggcatccgcctgctgtgtgaagagctccgtcacccgctctgccgtggcggggcaggaggtgagcgccgggtcctgtgccagcagctgctccgccgcctgacgggcctcctgcagcagctgggtgtcgcagcccagatccgccaccttcagccccggcaggccgtgctggcgcgctccgaagaagtcaccggggccccggagccgcaggtcctcctccgcgatctggaaaccgtcagtggtcttggtcatgaccttcagcctctgcctcgtctcctcgtttcggttgtcggagatcaggatgcagtaggactgatgcttcccccggcccacccggccccgcagctggtggagctgggagaggccgaaccgctccgcgttctcgatcaccatcaccgcggcgttgggcacatccacccccacctcgatgacggtggtggacaccaggatgtccgtctcatgggcagcgaaggcggccatgacggcgtccttctccttgggcttcatcttgccgtggacgaaggccaccttgagatccggaaacacctcggactggagctttttggcgtattccgtcaccgccttgcgctcgtcggggagctggtcattctcctctaccatgggacagacgatataggcctggcggccctcgcccaccagcttgcggatgaaacggtacacccgctggtgatagcccccggtgacggcgaaggtctgcaccggctggcggccggggggcagctggtcgatgatggacacgtccaggtctccgtagaggatcagggccagggtccgggggatgggggtagcggacatgaccagaatgtgggggtggtcccccttggcggccagttccgcccgctgggccacaccgaagcggtgctgctcatccgtcaccaccaggcccaggtcgcggtaggccacgctgccggtgatgagggcgtgggtgccgatggcaaagtcgatctccccgctctccagttgctgagtgatggaccgtttcgtcttggcggtggtggagccggtcagcagggcgcaccggatacccaaattttccagcagaggggccaggccctggtagtgctgctgggccaggatctccgtaggggccatcagggccgcctggcggccattcctcaccatgaagtacacgcaggcggcggccaccatggtctttccggaacccacgtctccctgacagagccggttcatgggcgtgccggagcgcatgtccgccagtgcttcctccacacagcggcgctgagcgtccgtcagggtgaagggcagggcacggtagaaaagctccatgtccacgccgccgcaagggggcacgtggaccacctcccggcgggagcggagccgctccagcccgatggtgaagaggaacagctcctcaaaggccagccgccgccgggccaggtccagggcctccgcgctctccgggaagtggatgttctcataggcgtactcgatgcggcagagctgatggtcccgccgcacacggtccggcagcacgtccggcaggatgtccgcgcaggcgtccagcccctggcggatggaccgggacaaaatcagctggctgactccggcggtaaggggatagatgggcacgatgcggccggtgacctcccgccgcccctccggctccaccacaggattggccatctgatgccggaggagggagccctccgcccggccatagaagatataggtctctccctggtgcaggctgtttttcagccacgcctggttgaaaaaggtcacatccagggtgccggtgtcgtccaccgcccggagcttcaccagatccagccccttgcggatgtgggagatggtgggcggggacgccaccatggcggccacgccggcggtctcgccgggcaccaggtccgcaatgcgccgcagggcagagcggtcgtcgtaggcccggggaagtaagagatcaggtcccgcagggtggcgatgcccagcttgcccagggccttggcccgctgctccccgatgcccttgatgtaccgcacatctgtgttcaggtccgccatggaatcacctcccgccttgcaaattattggtctccattatataatggcgccggagaaaaaacaaggagatgggcgcatggtcacctggaagaagtgggcggcccgcggagtctgatgtgtgggtttgttcggcgggatgatcgcggctggaaccggcctgtggcccctgggacccattggatcagcagcagtgatgatggtgttgggggctggtcctgtggagcaggcgatatcagcggtgtttgtgtgcccctcctgcggcgcagagttatcgggacaggacttccgatcatccaggtggagtccggatgggactgatgcattgccgcagttgtggagcgatgcttcccgtagaggaatgccgcagaaaagagctataaaaaagagcccggaatcccgggcacttttttgtaacaaaactactgcccatgcgtcctatggcagagaggaggggaggccgtgccggattttgaggagatctatcagacgtatttcgccgacgtgtaccgctacatcctggccctcagccgggacgcccacacggcggaggaggtgacccaggagaccttcttccgggcattggcctccatcgaccagttccggggggactgccagctgcgggtgtggctgtgccagatcgcccggaaccagtacctctcgctgtgccgggagcgaaagcaccggggagagctggagcaggagccgggggacgacgggctggagtgcgactttgcggaccgggacgccgccaagcggctccaccggctgctccatgacctgccggaaccctacaaggaggtgttctccctgcggaccttcggggagctgccctttgcccagatcggggagctcttcggcaagacggagtcctgggtccgggtcacctacttccgggcccgccagaaattgaaggagggatttgatggaccagctggaccatgatatcgtacaggacctgctgcccctgtaccacgacggcgtctgctcggacaagagccgggcggcggtggaagaacatctgaagacctgtgaggactgccgggccgccctaacggctatggacgcgcccctgccggaggtggaaaaggccgccgatgacgcggcggtagcagtgaaaaaaatatccggtgagtggaagaggggcaagcgccgggcccatatcattggcgtgattgttgccgtggtggtatgcgcggccgccgcagtggggatttggaccctcactacatggacgtgcatccccatggatggcggggactatacgctggatgtttaccggctgaggagcggaggcgtgggggtccactgggattttcgggagggccgggagacctggtatgccctgacattccgggaggaggcggacggacttcactactatctggagcggcccattctccgggtggagttgtttgactttgacagcaactataaccggggcggggacgccatgtttgaaagctggtcggatgatgccatggagaccgaagcgatctacttcggcttgggtgaggatgccgtcttgctgtggaaagagggcgaggaagtggacttgcccgccgccaccgccgcccaggaggagatgtgggcgattgcggaactgccaccgcaggaggtgccgcaggaatgagaaaagatgtcattccagtggaagatgcacagggcgggccgcgcagcccgcggcgtttcctccgtcttctggccctgctcctcgccgccttcgccctgctctccgctgtgtggtatttcacagcctaccggccctatgatgtttacatggaggccctgcgggcccagcccgggtggcgggaggctccggccctcccggggtgcggcacggatggggagggttacaactgtaatgtggcccggcctggatttctccattggacggggaatctggggattggcatgccgaacctgacgctggaaaacggggaggaggtgggcttcacagattccctcctgatctggccccggatgaccggcgagccggaactgggcgtccttctctttgagtatgactttcaggaggacggcgtcacctgtgccggccaccagctctacattacggcggcgggagagtaccgcccctatggagatgcggcggaggacgcggccaatgcgcagctgctggcggagcaccaggagaacgtggagacgttgctgtcccgggcccgggagatctggggcctgccgtgactcacaggccatggagcaaaaaccaggcggcccgccgggatctcccggcgggccgctgctcaatcgcacagcttcgtattcacatagtcatagaaccgataggtgagcccgttctccgtcaccggctcgctgacggctcttacagtccagccgggcagcttgtccagattgggaaagaaggagtccgcgccctccgcggcggcgtccacccgggtcacgtaagcccgtgcacattgggagagcagagcggcgtagatgctgccgccgccgatgacccacagctggtccggcggggtaccggctgtggcctcccgcatggccgccagactggagacggtctccgctccctcccgggaaaagtccgggcagtgggtgatgacgatgttccgccgcttgggcaggggccgcccgccgggaaaggagtccagcgtccggcggcccaggatgaccgtgccccccagggtgagggagcgaaagcgcttcatgtccgtaggcagggagaagagcagatcattgtcccggccgatggcccagttttgatcgacgacgacgatggcattcacagcgcaggcctcctcaaatagcgatggggatctggtcctcgaaggggcggggatgtagtcctccagggagaagctgtcccgggtaaaggcgtagaagtccgtcacggacgggtccatccggaacaccggcgccggggacggcgtctgggccagcatcttttcaatgatgggcacatggcggtcgtagatatgggcgtccgcgatcacgtggaccagttcgccgggcaccaggccgctgacctgggccagcatgtggaccagcaccgcgtactgcactacattccagttgttggcggccagcatgtcctggctccgctggttcaaaatggcgttgaggacattcccggagacgttgaaggtcatggaccaggcgcaggggtacagattcatctcatggagatcctggtggttgtagagactggtgaggatgcggcgggaggcggggttgtgcttcaggtcgtacagcacccggtccacctggtccatctccccttcgggatactggtgcttgatggagagctgatagccataggccttgccgatggagccgtccggatccgcccactcatcccagatgtggccgttcaggtcgtggatgttgttggacttcttctgccagatccacagcagttcgtccaccgcggtcttccagtaggtccggcggagggtcaggatggggaactcctcctgaaggtcatagcggttgacgatcccgaattttttcacagtgtgggcgggagtaccgtcctcccaatggggacggacgggcaggtctgtgtcccagaccccgtggtccagaatgtcccggcagttttgcagaaagagcgcatcggcacggctcatgggggtccctcctcagcgttgggtatttttttcagtatagcaaatccgggagaaaaacacaatcggcagatgaagccccggccgccaaattgggggcgtcttttcctgtgcctgttgtgaaaatcggctatgtgtggtagaatacctgcaaaacgggccctgcctcatcgggcgcggcgcccggttccacggccgaagagtgacccggcggatgctccggcgggcggaaaaggaggcgggagatgccggaccggaaggagatcaacaagcggggctatctaaaggaggacttccggctgttccacctgaaggacagccgggcccagaaggtggactatcactaccacgcctttgacaagctgatccttctcctgggggaaaggtcacctatgtggtggagggcgtcacctacttccttcagccctgggacctgctgctggtgggacacgacctgatccaccggcccatcatcgacccggcggagccctatgagcgggtggtgatctggctgggacgggagtggctggagcggcgcagcgaccccggcgaggcgctggacacctgcttcgacaccacccgggagcgggggttccacctgctgcgcttcgacgcagagcggcggctccactatatgcagcgcatccagcagctggaggaggccctgcgggaccggagcttcggcgccgcccgcatggcggataccctctgccagcagatgctgatcgacgtgaaccgggatgtgctgcgctcccgcaccgcccaggaggagcgggacagctaccgggtggaccccaagatggaggaggtgctccggtacattctggaccatctgggagaggagctgacggtggagtccctctccaagcggtttttcatcagccggtactatctgatgcaccggttcaaggccgtcaccggctacacggtccaccagtacatcagccagaagcggctgctgcgggccggggagctgatccgcgccggcgtgccggtgatgaaggcggcggagcaggccggatttgaggagtattccaccttcctgcgggccttccgcggcaccttccacatgagtccccgggagttccggtgacgaggatacggcaaaagcccgcccggggatcgctccccgggcgggcttgctgttactgggcctcgccggctgccaggcggaggatagcctccatgtccgcgggctggatcttcacgaagccgccgaaggggaagccgccgggcttctccgcccggtgggccaccatgtccgggatgtctttggccttggctcccagctcgtcaaaggtgatgggcatccccagggagtggaagaagaggcacagcttctcgatgccctggcgggcggtggcctccgggtccgcaaagttcatctcacagccgaagacccgcacggcgaactgggccagccggacgggatcatggggcagcacgtactccatccaggcgggcaggatcaccgcaagacccgcgccgtgggcgcagtcgtagaaggcggagagctcatgctcgatctggtggctggcccagtcctgctcccggcccacgccgcaggagttgttgtgggccagcatccctgcccacatcaggtccgcccgggcggcgtagtcattgggatcggcaatggccttgggggccgcgtccagcacggtcttcagcagggcctcgcacagccggtccgtcagccccacgtcgggagtgttggtgaagtaccgctccatgatgtgggccatcatgtccaccgcgccgctggcggtctggtaggcaggcagggaacaggtgaaccgggggttcagcacggcgaatttcgggcggatgacatccgtcttggggcaaccccacttcaggttgccccgctcctgggtgatgacgcagctgtcggacccctcgctgccggcggcggagatagtcagcaccacgcccacgggcagcgtcttctcgatcttggcggcgccggtgaagaaatcccagaaatcccccttgtacagcgcgccgaagccgatggccttggcggtgtcgatgacactgccgccgcccagtgccagcaggaagtccgcgccggtccgccggaccaggtcgatgccctcgtataccttgccgctgcgggggttggcctggacgccggagagctctgtaaaggggatgcccgcggcctccagggaggcggtgacggcgtcataggcgccgttgcggcggacggacccgccgccggtgaccagcagtacccggctgccgccgaaccggcgcaccagcgcgccggtgttttctcttctccatcgccgaaggtgaagagggtgggggagtagaaggtgaagttgttcatggatgaagttcctttccttaaaaattcaacaacataatcagtcccgcttggatagaagcacctcaaataccagcagggccagagctatcgccagcaggagaagccccgctgagagaacggccccgcaccaggtgctgcgcagagcagtgccgaagcggccgaaatcggtgtaccactggtctgcggtcagtgcatgatagacagctccggtcagccctgtcaaggcggctgctgttcctgcgaaggccagaggcggagagatcacccggagactccaccgccacagtggaagagacaggaagtcggacgcatcatcagccttggcattctcccccagcagttcatcggcggagatgccgaagacgcggcacaattggagaagcttttccgcatcaggaaggacctcgccgctctcccagcggctgacgtcctgcgtggagacgcccagccgctctgccagaatctcctgagagaggtgggcagccagccgcctctgggtgattttttcgccgatggtcatgggaaaactcctttcgcaaatagctttcgtatatcactggcctgccccggcggactgcttaatatccccggttccggtccaccagtcccgccagcgggcgcccggcggcgtagttctccagatcggcacagaagcgggctacgttttcgtcgcaggtgtagcccagggtcatgttgccggagacgtgggggtgagaatgatgttccgggcgtcccacagaggatcgtcctggggcagaggctccgggtccatcacgtccagggcggcgcctgccagctttccgctgttcagggcctccgccagggccttctggtccagagcggtgccacggcccacgttgatgacgcaggcgtcggcgggcagcagggcgatccgctcccggttcaggatgtgaacggtctccggcgtgctgggcagggccatcaccaggatttttgtgcggggcagcacgtcgtccagagcggagatgggatacacctcgtcgaaggcggggtggggctttccgctgcggctgagacccacgatcttcgcggcccccatgccccgcagccggtccgccacatggcgtccgatatccccggtgcccaggatggtgaattcgttgtcccggatggagcggacgggcaactgattggaccagccgtggcctcggacgatttcgatgtactccggcatccgccgcagcagcatcagggtcaccatcaccacatgctcggcgatggtaacgccgtagacgttggagttggtcagcaggcagtccgggttggcgaacaggccagggtccttgcagtagaggtccaccccggcaaaggagcagcagtaccacttcagcgtagcgggagcggcgcgcagaaggtcagcggaatgggcgtacagaacctcgcagtgctggaggcagtccttcgcctcctcaaactggtccaggttgaagaaatggggggtgaagcccgtccggcgggcggtctcccggatccggtccttgtgggcttccgtgaggaattcctgatagatgcagatattgcgattcataaacaatcagactccttttgaatggattgacagagttgctcggcacagtgcatcccatccgcggcggcggagaggatgccgccggcatagccggctccctcgccgcaggggtacaggccccggagagaggactggcaggtcccatcccgtgggatgcgcacaggggaggaggaacggctctccaccgccgtcaggacggcgtccggatcgtcgtagccccggagcttctgccccagcagggggagcgccccggcaatggtatccgccacgaagggcggcaggcaccggcgcaggtccgtccaggtgacgccggggcggtagctggggtgcactcggcctgggccgacggaggggcgccccgccagaaagtcccccacccgctgggccggggcccggtagtccccacccccagagcgtaggctgcagactccagcttccgctggaaggcgatacccgccaggggatcttccgccccgccatagtcctctggcgtcacgttcaccagtaggccgccattgatattctccttgtcccgggcgaattcgctcatgccgttggtgaccacccgctccgcctcagaagcggccgccaccacctccccgccggggcagacgcagaaggagtaggccgcccggccgccgggcagatggcaggagagcttgtaggtagacaccggaagcccgggatgcccggcgtactgccggtattgggcggcgtcgcagtccgcctgccggtgttcgatccgcacccccacggcgaagggcttggcctccatgggcacaccccttttatggagcatggcgaaggtgtcccgggcggagtgccctgggcagaggagcaggtgggagcagggaagggtataaacgccctccggcccctccgcggtgatgccccgcagggcgccgtcccggatgtccagatccgccagccggctctcaaaccggatgtccgttcccagttccagcagacggcggcgcaggtttaccagaacggtgtggagataatccgtgcccacatggggtttggcatcgatcaaaatatcctccggagcgccgcaggataacaacgtctccaggataaagcggtggcgggggtcgcgtgtgccggtgttcagcttcccgtccgagaaggctcctgcgccgccctcgccgaattggacattggaggtcaggtccagctctcccgtggcccagaaccgttccacatccgccttccgccgctccaccgggcggccccgctccagcaggatggggcgcagccccgcctgggccagcaccagggcggcgaagagccccgcgggcccggcgcccaccaccacgggaggcaccgccggcgcaggcaggggagacggcggcgtgtacgccggggcctgtgcggcccggctgatcttccggctcctggctcggcggagaatagcggactcctccttgaccgcgacctccaccgtgtagaccaggcggacttcttcccgggcgtccacactgcggcggagtaagcgcagggagagaatgtccttctcccgcatccggagcagccgggcggcctcagcggccagctccgccatgccggcctccggcgggagcttgatggaatcgattcttaacaccttgttcaaagttcctttcagatgtgtttaagataagcatactatacttcagtcaaaggttcaaggaagagcccctgaaaagcttccggttttttccggagcgccgtccaggacaattcaaaaattggaatcagaaacttcatacttttgacacgatcccatgttatcctctgttctaaacaatggatgagcgggatacataataggaggcaatcattatgtataacgacgaacacaatctctatcactacacctaccggaaggacggcagcgaggcggaggcgcatccggctccccagcccggcccggtacaggaccataacagcgggccgcagcagcccgtgcaggagatgaagcctgtgaagaaaaaccgcattggactgaaggtgacggccctggccctgtgctgcgccctgctgggcggcgccgtgggcggcggcattgtctggggcgtcggcagaagcggcgacgagacctcggtcaacgtcagcggccgcaccgtcagtcaggtcgcactgaaaaccgtggacggcaagacggcgatgagcgacgcggaggtttacgccgccaatgtcaacagcgtggtgtctatcaatgtcaccgggaccaacagcaacaacttcttcggccagccggtacaaacggcatcctccggctccggcttcattctcaccacggatggctatattgtcaccaactaccatgtggtggaggacgcacagaccgtgaaggtcaccttgtataacggcgatgaatacaacgcccagtatgtgggcggcgatgaggactacgacatcgcggtcatcaagatcgaggcctccggcctgcaggccgtcaccctgggcgacagtgagaagctgaatgtgggcgaccgggttctggccattggcaaccccctgggggacctgacgttctccatgagcggcggcatggtctccagcgtgaaccgcaccatcaacgtggacggcacgcccttcaatatgatccagaccgatacctccatcaaccccggcaactccggcggcccgctgctgaacggctacggtgaggtggtgggtatcgtgtccgccaaatactccagctacggcagctccggcgagagtgtggagggcttgggcttcgctatccccatcaatgacgtcatcagcatgatccaggacatcatgaccaacggctatgtgagcaacaaggcctatctgggcgccaccatcggcaccctgaccagcggcatggcccagcagtaccgctatgatatcagccagggtgccttcgtatactctgtggaggacggcagtccggcggctgcggcgggcctgcagttgggcgacgttatcaccgccatcgacggcacggagatcacctccctggaggacctgaccgccgccaagaagggctatgcggccggcgatacctccacactgaccgtctaccgccagggtgagaccatcactctggagctgacctggggcgccgtgtctgccgatcagcagtccgctgtgcagggccagacggagcaggatcagaacacccagaacggcggcgggtacaccaatccttacgacctcttcgagtacttcttcggctgatggcgggagactcccgcagccagaaataactctgcggcccggtggcggctctgcggcagatgctgcggaagggcaaaaagccgccggatgcggcgggcggcggagatttcagatagaacgaaaagggcgcaccgcggaaccgcggtgcgcctttccagtatggaagcggcgtccatcgaaatggacgccgcttccgcactgaataaaaatgaagggagagatggaaagcagaatcatttggaggcaggctcctcctctttagcagactgcttgtttttgtgggccttgatggagctgttgatgcagcccagcgccaagacagcaacgattgcgagcatcacatagccgccgacttccatgagaggacacctccttcccgattcggattcgaggatttatttacgaaaagttgtcatgaatataaaaatattaacggattcttaacgacctcttaacgatatcttagcgccaatgagccaaaaaagcaagccccttttcggaaaaattttttgcgctttccgaaaggggctcagtccagaaaatatcccagggaggcaaagacctcagacagccgctgggggccagaatctcgatcctgcggtaagactggcggaggatgccggcctcccgaaactgtttgaggatgcgggtgacggagacacggctcataccggtgatggccgcgatctgctcgtgggtgtacggaatggagggaccggagctggcgcagcaggtgtgcaggaaataggccacccgcttgtcatcctccagaaagtgggaacagcagatatagtcggacagcatggtgatccgccgcacaaaatgggccatcaggtcctggggaggatagccgtgctcctgccacagcttccaaaagcggtctgccgccagcagatagacctccgccggagagatggcggacacgctgaccatgaccttggcgtgatacaccagggcgctgctgccgaacagattgccgggtcccaggtaaaagagggagatctcatctccgctgggaccgaggcagaaggtgcggagctgccccttgaccagaaagcctgcctgtgcggacagcgcacccttttccagcaggacctcgccgctgcggtactggcgtctgacgccgtatttgacaaaaagctcccccacgtgggggctgatctggatgtcgccggacacggggcatcccgcctcctttcctgagaggattccatatcaacatcaacaaaaatagtagcagattttctcccattccacaagatgcatttgtatcacctgttacaatctggccgccggctctccctttacaataagcatatcccgactgagcggctcggtcagaatgccgcgcggcgcggatcaaaaaggaggagctgacaatgaaggataccatgtgcggccttgtcaaggaggtcaacgccccgtccggcctggtctatcacactgacctgtcgatcccggagatcaatgacgatgaagtcctcatcaaggtccactgctcggccatctgcggcacggatctgcacatcatggaatgggacgagtggtcccagaagcggatcaaggcccccgttaccgtgggccatgagacagccggcgagatcgtggcggtgggaaaaaacgtcacggagcgcaaggtgggcgaccgggtgtcctgcgagtcccatattccctgcggcgagtgctatttctgcaagaacgggatgccacacatctgcaagaacgtgaagctgttcggctgcacccagaacggagccttcgccgaatacgccaagatccgctgggactgcacgttcctgttggaggatgacgtcaccgacgaggcggcctgcatgttcgagcccatgggcgctgggattcacggcgtggaggcggcggaggtcaacggaaagaccgtgctggtcagcggctgcggccccatcggtctgacagccatcagcgccagcaagaccttcggcgctgtcaaggtcatcgcctgcgacctgatcgatgagaagctggaggtggccaagaagatgggcgccgacgcggtgctcaacagcgccaagtgcgacctgccggcggaggtcaggactctgaccggcggcgtgggcgtggacgcggccatcgacatcaccggcgcggagcccgccctcaacagcgccctcaagtgcctgcgggctgcgggccgtctggtgtgcgtgggactgcccaccaagcccatcaccttccacgacatgaccgacgacctggtctatcgggaggtccagctgaccggcgtctccggacggaagatctgggagacctgggaggacttcgccaaggtcatgaagggaccctatttcaagctggatcaggtcatcggtggccgcttccccatgaaggactttgaggccgctctggcgcagatccacagcggcgtgcccggcaagatgatcctgtatccctgatcccgccccgcagaacaggcaggaggagactgtgcccattctgcggcggaccctgacccggcccggagatgctgaacgatcctgaaacacccccgccgcatcgcggcgggggtgttctgcgtcagtccggcagatggaagatatcctccacaggggttttcagcagccgggccagccgcatggccagccccagggtgggatcgtacttgttgttctcaatggcgttgatggtttggcgggtgacgcccagctcccgtgccaggtcctcctgccggagccccgccgccttccgcagctcccgaatccggttttccatagctcacagccccgcgcaccgcagcagcaggccgaaggccagcaggaagactaccagcagcgggacatacagcaggaagctcctggcgccgtcccggtccccggcgcgccatctccccacctgcagggccagaaaatacaggagattctgaaagatcaacaggtacatgggcgcggtgacgcggccggtctggacgcagtcccagatcccccatataaacagggccatcaccgtgaagaaccaggccacccggatggcgttcagggagaggtgaagttccatctcatccatgttccgaaagaatttcatagaactgcctccttgctttgaattgtcaagttcttttgacatttttagaatagtacggcagatgcgaaatgtcaatagtgttttacatttttgcaaagaggatagaaaaacgtcggggaacgcaggctgacccttgcacttttgggcctgaaatggtacaataattgtccgaaaatatcagcaagggagagcgctgcttttatgaaattaggaatcgtgggtctgcccaatgtgggcaaatcgaccctgttcaacgccatcaccaacgccggcgccgagagcgccaactatccgttctgcaccatcgaccccaacgtgggcatggtagcggtgccggacgagcggctggacaagctggcggagatgtatcagccggataagaagaccccggcggtcatcgaattcgtggacatcgccggactggtgaagggcgccagcaagggcgagggcctgggcaacaagttcctggccaacatccgggagaccgacgccatcgtccacgtggtccgctgctttgacgacgagaacgtcattcacgtggagggcagcacggaccccaggcgggacatcgacatcatcaacatggagctggtgatggcggacctggagatggtccagcgccgggtggagaaggccacgaaagccctgaagggcgacaagaagttccagcatgaggtggacgtgttcaccgcactgcagaagcatctggacgggggcaatctggcccggacctttgcctgtgacgaggacgacgcggccctgatcgccacctccgacctgctgaccctgaagcctgtgatctacgccgccaacaccgacgaggcgggcttcgccgatctggagcataaccagtactaccagcaggtgaaggccattgccgacgcggaggacagccaggtgctgcccatctgcgccaagatggagcaggacatcgccgagctggagggcgaggagaagctgatgtttctggaggagctgggagtggaggagtccggcctggaccggctcatcaagtgctcctacgctctgctgggcctgatctccttcctgacctacggcaaggacgagtgccgggcctggaccatcaagaagggcaccaaggccccccaagccgccggcaagatccactccgacatcgagcggggcttcatccgggcggaggtcatcgcatacgatgacatgatcgcctgcggcagcgtcaacgccgccaaggagaaagggctgctccgcagcgagggcaaggagtatgtggttcaggacggagacatggtctacttccggttcaacgtatgatgacggaggcggagagactggcggcctatgaccgcatgtacgccgacctgctgaaggaacgggacaaggtcctggcggacatggacaagctccgcgccgcgggaaggaatcggggaaccacctaccagcagctgttggcccagaagctgacggttcagaacctgatcggccggtttgagatctacggaatcaaagaagtgtgagggacaggcaggcgcaaatgcgcctgcctgttttgcctgcggagagggatctcctgacggcaggccggtcccatgggcaaaagggaccgggcgtctggcaggacagcattccatatagcgggcggccgtccgctgtccggcagaaaaattcccagggggaaacatttcggcccgccccggcgtatataggttgaaagcgcttttcaaacgagagaaaggaggcattgcatggaagaggctgaaatcctgctgcgcaatgccatggaacaccacggtgccgccgtctaccggctggccctgtgccggatgcagagcgtccaggacgcagaggacgtgtaccaggacgtgtttctccggctgctgggccaggaggcatctgcctgggacggggagcatctgcgggcctggctgctgcggtgcacggtgaaccggtgccatgacctgcaccgcttccgcctgcggcgtccggtgctggcgctggcggacctgccggagacggccgcggaagcggacagcggcgccgcagagctgtgggacgcagtggcccacctgccggaaaagctgcgcgtccccatccacctgtattatgccgagggatattccacggaggagatcgccgggctgctggacattccggcggccacagtccgcacccggctccgccgggcccgaaaaagactcaaagacctgctgggaggagacgaccatgaagaagaacgactatcagaatttgatggagcatatccagcccccgccgggctgaatgaccgggtgctgtccgccgcccggcagacggcgggagcgcagaaggagacgaccggccccaaacatctggcgcccggaaagcggcgcccggtgctccgggcggcagtatgcgccgcctgtgcactggcgctggtggtaggttctgtaacgctggggcccattggcggcggagagcccggagagagcggcgcgccggtaacagccctgcccagcttctccttcggcctgacggcttatgccgctgacacgggggagcgttacgaggcgaacgccaacggggggctggccttcagcacagccggtcaagtctcctggtctgccgagggcggccactacaccggctgtctgttccaggtgaccggggagaacattcgaaccatttcccttgccattgaccgagaggcgctgtaccgcagcagaactctgaccaacctctccagagaagaggtgcagaactatctcgatgccgaggccaacggcacggagtaccggctttccagcggcgaaggagtgatccatgccgtttatggcgaggaggaagaggggcccctgaccatggaggtggtgacggatctgggcgctgccgtcacggagggctatgacccggaggtgcgctatggattcctgattccggacaccggcgatatcgactgggacagggatccccgggtggcgaatcaggagagcatcgaccggatggacggcgctcggctgacggtgacggtgaccttcactgacggttcggagcagaccaagacctacacgctgtccacagggcggctgaaggtggaatatgacgcaaacagccccggcgggatcctcctgccccagctggccggtgatgaagacccgtggctctacggcgtctatgcggtggatgagacggccagccgtttcctccagtggccggtgcagggagccaacaccatcagcctctccaacccctatggtacccccggtggcagccgggcggcaagacctgtgaaactcacaccggaatcgacattgccgcgccggagggcgaggcagtcctggccgcagcgggcggcactgtggtggagtccggctatgacgtggagcgaggcaattatgtggtgatcgaccacggggacggcctttctaccctatatggccagtgccgggactttacggtggaggagggcgacaccgtccgggccggggagatgatcggtgccgtggggaagaccggcatggcaacaggggcccatctccactttgaggtccgccaggacggagagccccagaacccggtggcctattttgacagcgacgtgcgggacaccctccgcatgggctgaccggtcctctgtgaaaagaacagtgagcgcggcgcggaatttgttccgcgccgcgctcgttttcggctggggtcaggcccggggcctgcgggcagcccgtcgggcctccgcttttttctccaggttggagaccaccagggcgcaggcagcgtcgcccgtgatgttcaccgtggtgcggcccatgtcgaagatgcggtccacgccgatgaccaggccgatgcctgccaccggcagattcacgctctccagcaccatggtcagcatcaccacgccggagccggggacacccgcggttccgatggaggccagggtggcggtgagcacaatggtgatcatttggcccagggtcaggtccactccgtagcaggtggcgatgaacacggcgcacacgccctggtagatggcggtgccgtccatgttgatggtggcgcccaggggcaggacgaagctggcgatgtcccgccgggcgcccagccgctccgtgcactccaggttcaaaggcagggtgcccacggaggaggcagaggagaacgccatggccatggccgggaacatccccttgaagaaggccagcggactcacgccgcccagggcctttaccgtggcagagtagacgatgacggcgtggaggaagtacccgatataggcgcacagcagcaccaggcccagattgcccaggatctggggaccgttttccgccaccaccggcaggatcaggcagaacacgccgatgggggagaggcgcaggatgatgtccatgaccttcatgcagacctctgtaaggctgtcgaccagcgccgctgcgggccgtcccttctctccggcggccaggatgccgaagccgaacagcagcgccgccacgatcacctgcagcatggaggcgttggcaaagggggcgatgatgttggaggggaagatgtccaccagcgtgtccatgaagctggcggtctcaccgggctcaaaggtgacaccggtggggtcgatgaccgtgaagaagcccttgaacaggttggccaggaacatggccagcacgatggccccggcagtggtgcaggtataatacaccagcgttttgacgccgatggaacccaccttgcggatatcgctcatggagatgatgccggagagaatggagaaaaagacgatgggcaccaccacgaacttcagcaggttcaggaaaatggtgccgaagggcttgatatagctgacggcaaaggtgggatttcccgtgaaggccatgccgaccgcgatgcctagccccagcgccagaaagatttggagggagagaggaatttttttctgcttcatatacgcgctcctttgcttggtgaactgttgtgcagggccattcggcggaaagaccgcccgaaatggccgaaaactaatctagtatatcaaaaaaactgggacagcacaaccctcttttgcaacagagtgcccatttccgctgcttagaaacctgatttcaatttctgtttattttgtcaggaaggcggagggtatagatacgatcccggcatggatggcagagatggagaagagaacctggcatctccactgggcggcgtgggaaaagcggcggatccgggctcgaacattgacggcctgtaaaagagtcccccggacagaaaacgacctctcccgatccggagaggccgtttgttcagtcatgggcgtgaggcaggttccagcggaagtgggcggagaggatgcggacggcgaccacaagcgcactgccgcagagcatggcggccatctctcccgccaggggccagaggaccacgcaggccagcgccccggccagggaggcggaggcatagacatgcttgacgaaaatgtagggcgtgtccccggccagcacgtcccgcagcacgccgccgcccacgccggtaaccacgcccacaaacaccagcaggaacagggtggggcgggccgcgtgttcataggcaatgcggatgcccgccacagtgaaaatgccaaggcccgcggagtccataatcagcagcaccaagtcgtagagccgctggtcccacatgaggagccgccggatgcggggcagaaacagcaccagggaggtcagcagggccaccacggcgtagatgggatcctggaaggtgcccggcggcgtgatgcccaagagcaggtcccggatgacgccgccgcccaccgcggtggtgaggcccagaatgcagacgccgaaaacgtccatgttctttttcaggccggtgatggcgccggaggcggcaaaagcgagcgtcccaaccagctccaggatcagaaacagctgttccatggccgtcaccgggcgtcctgccggaccatctccataaaggcggaggccgcggcggtgggcgtcacgtcccgcagggtgcacatgtccacgctgcgggcaggaatggtgaagtcggttttcagcaggcggatgtccccgctgtccagggccttctgcacaaactccagcgtcacaccggccacccccaggccgatccgggccagggataccagaaggctccgggaggagagctcgatttccggcgtcagggtgatgccgctttgcagaaagtactgctccagaaacacccggctgctggccttgcgctccagcaggatcagggggaactccgcgatctcctgccgggtatacacgtggtcgaagtcacagtcgtagccgctgcccgccacaaagacggagtgggtggcgaagcaggaccaggtatgcagcgcggcggggtccgtgggggaggaggcgaaggcgatgtccacagcgccggatttcagcatgctcagcaccttggcgctgcggccgctgacaatcttcagccggatgcccgggtgctggcggtggaaggcctccaaatatggcgtcaggaaaaagctggtgacagtgtcgctggcgccgatagtcagggtgcccagcaacagctgctgggcctgggacagcttgtcctcccctgtggccagcaggcccagggcgctgcggacatactggtagagcatctgcccctcccaggtgagggagacgccccggggactgcgggcgaacaggcgggcctggagcgccgtctccagctgcttgatagactggctcaccgccgactgggagatgtagaggttttttgccgccagggagatgttgcccgtctccgccacctctttgaacactcggtacagctccagcttgaccgccatggatcatccctccagcaatcagaatttcttatagtgtccggaatcattataagggatgactggaggaaacgcaacggcggcggaaaaattttcggtttttctttgcaagcgggatggtttttggtatactaacacattagattgtaaagacgggaggcgcgctatgctgtatcacattctggcagtgggcgacgtggtgatggagcccggcctccgccatctggagcggcacctgcgtcccctccagaagtggaaggccatcgacttcacggtggtgaacggcgagaatgccgccggagtggggctgacccgcgaccaggcggagcggatctacgacgccggtgccgacgtggtgaccttggggaaccacgccttcggcaagagccagattgcggatttcctggaggacgcgccctggctgctgcggcccgccaactacaccggccgggccccgggtcggggctgcggtgtttacgacctgggcggcgtccggatccgggtgctgaacctgatcggccggtgcgacctggcctggggggcggacaaccccttcacggcggcggaccggctgctggagagagacgcggcggacttcaccctggtggacttccacgcggaggcaaccagtgagaaactggccatgggctactatctggacgggcgggtgtccgccctgtgggggacccatacccacgtgcccaccgctgacgagcgggtgtgtcccaggggcacgggctatattacggatttgggaatgaccgggtccatcgagtcggtgctgggcatcgacccccggcagtccgtggagggattcctgggcggcctgccgggccgctaccgggcgccggagggacccgccaagctccagggggccatcttcacgctggacagcgccaccggactgtgcaccgccgtggagcggatcgacgtacggtgaccgggacgatttcaaaccggctggttaaaatttcagatagagaggaacgaaccatcatgtccattgaaaaagtcagagcacatttcaagcccctcggcatcgaagagcgaatccgggagttcgatgtctcctccgccacggtggagctggcggcggtggccgtgggtgtggagggcgcccgcattgccaagagcctcagcttcaaggtggaggacaagcccatcatcattgtggtggcgggggacgccaaggtggacaacagccgctacaaggcccagttccacaccaaggccaaaatgctgacccatgaggaggcccacgagctgatcggccacgacgtgggcggcgtgtgcccctttgccctgccggaggatgtgaaggtgtacctggatgtgtccatgaagcggttcgagacggtgttccccgccgcaggcagcagcaacagcgccgtggagatgacctgcgacgagctggagcggtacgcctccaactttgccgcgtgggtggatgtgtgcaagggctggcggcccgaggagcagggatgatccggtttctgcacggcgcggacttccacctggacagcgcctttggcgccctgccgcccggacaggcggcggcccgccgccgggagagccgggagctggctctccgtctggcggactacgtgaaggaacacggcatcgatctggtgctgctggcgggggatctgttcgacagcgccagccccttccgggagacgggggaacagctggccgccgctctgggacagatgcgggccagggtgttcatctcccccggcaaccacgactggtacggacccggcagtccctgggagacggtggactggccggagaatgtgtacgtattcaaagagaacaggctcacggccgtggaggtgccggagcggaacttggtgatccacggggcggcattctccggcccggaacagccggagagcctgctggcgggtttcaccgccccggcagacggaaagtgtcacatcggcctgctccatggggagctggacggggcggaggcgcggtacggccccatccgccgggaagaggcggcggccagcggcctctgctatctggcactgggccacgtccacaagcggacggcgcccctgacactggggcggacggtctgcgcctggcccggctgtccggagggccgggggttcgacgagctgggggagaaaggtttttacgaggggacgatctccgacggcggagaggtctccctgacctttgtgccctttgcccggcaccggtatgaggttttagaggtggacgtcaccggaaaagagccccgggccgccgtggaggcagctctgccgccggagacggccggggacctgtaccgcatcctcctcaccggcgagaccggagagggcggcgctggcgccgcggccatccaggaggcgctggcggaccggttttacgccctggaggtccgggaccgcacccgtatggcggaggacctgtggcggcgggcggaggaggactccctccggggcctgtttctccgggagctgcgccagcggcggaagcaggcggagacggaagcggaacgggcggagatcgacctggcggcccggttcggcctggcggcgctggaccaccgggatctggggtgagcggaggagcggatgaaatgaatgagatgaagaagattctgctgatcggcactggcggcaccatcgcctcggacgtgacggacagcggccttgcgccggagctgaccacggagcagctgctctcccatattcccgggatctcggacatctgcggcgtggactgcctccagctgctgaacctggacagcaccaacatgaccccggctcactggctggagatcgccgcctgtatccgggaccactacggctgctatgacggctttgttatcacccacggcacggacaccatggcgtatacggcggcggccctgagctatctgatccagggtagtcctaagcctattgtgctgaccggcgcccagagacccatcggatttgattccacggattccaagacaaatctggcggacgccttccgctgcgcggcggaggacctgccgggggtctctatcgtgttcaacagccgggtgatcctggggacccgggccaagaagacccgctccaagagcttccaggccttttccagcatcaatcacccggagctgggcgtcctgcgggacggcgtgctgctgcggtacatccgccaggactgccgggaggccccggtgttttacgaccgcctggacccgcgggtggccctgctgaagctggtgcccggcaccgggcgggatgcggcggacttcctgctggagcggaacgacgccctgattatcgagagcttcggcgtgggcggcctgccggaggcgggcggcttttacgactgcgtccgccgctggatggaggcggggcgggtcgtcgttctcaccacccaggtggagaatgagggcagcgacctgggggtgtatcacgtgggctaccgcctcaaaagcgatctgggggtgctggaggcctacgacatgaccacggaggccgtggtggccaagctcatgtggatcctggggcagacccggcggcgggaggaagtggagcggctgttctacacaccggtggcccgggacatcctctggcccggcctgtaaagacagagggaaccgacgtccggaaaaaggcaggttcccccacttgacaaggaaaaaggcccgtgatatatttatttttactgaaaaaagcattgaaaaggacgctgtccgggactcgacagcagagagggaccgccgctggctgaaagcggaccccgccagagcccggaacacagccaccgccttggagccgcccaccgatatgtaggctgggacgggacctcccgttatagaggacacgagcggcatccctccggggatgcaagcagggtggaaccgtggaatacgattttgtatcccacccctgatttttcaggggtgggatttttgttttctgccccttgaacaaaaggaggatcaaccatgtctgaagaagtgaagaacaacgagtttacctttgagaatccggcgtaccgccagacctactggcacacctgctcccacgtgatggcccaggccgtgaagcgcctgtggccggaggtgaagctggccatcggcccctccatcgacgagggctggtactacgacctggacgcccccttcgccttcacgccggagcacctggagaagatcgaggcagagatgcggaagatctgcaaggagaagctgaagctggagcggttcgaactgccccgggaggaggctttgaagttcatggaggagaaggcagagccctacaaggtggagcttatcaacgacctgcccgcagacgcccatatctccttctacaagcagggcgagttcacggatctctgcgccggcccccatctggactccaccggccgcatcaagggcaacgccctcaagctcaccgcttgcaacgccgcctactggcggggtgattccaaccgggagaccctccagcggatttacggcatcgccttcccgaagaaggacgagctggatgcctacctccagcggatcgaagaggctaagaagcgggaccaccggaagctgggccgggagctgggcctgttcatgctgcgggacgaggggcctggcttccccttcttcctgcccaagggcatgaccttgaaaaacaccctgctggattactggcgccaggtccacaagaagtacggctatgtggagatctccacccccatcatcctcaaccgtcagctgtgggagcgttccggccactgggaccactataagcagaacatgtacaccactgttatcgacgaagaggattacgccatcaagcccatgaactgccccggcggcatgctggtctacgccagcgagcctcactcctaccgggagctgcccctgcgggtgggcgagctgggcctggtacaccggcacgagctgtccggtgcgctccacggcctgttccgggtccgctgcttcacccaggacgacgcccacatcttcatgaccccggaccagatgaaggacgtgatccaggagacggtccgcctgttcgacgaagtgtactccaccttcggcctcagctacaccattgaactcagcaccatgccggaggatcacatcggcactgtggaggagtgggagcataaccaggacatcctgaaaaacgctatcaccgacatgggcaagaccttcgaggtcaacgagggcgacggcgctttctatggccccaagctggacttccatctggccgattccctgggccgcacttggcagtgcggcaccatccagctggacagccagctgccggagcggtttgaactggagtacaccggagaggacggccagaagcaccgccccgtcatggtccatcgggtggttctgggcagcgtggagcggttcatcggcgtcatcaccgagcactttgccggcgcgttcccggtgtggctgaacccggtgcaggtgaaggtcctgcccattacagaccgcgccctggaatacgccgatcagatcgcaaagcagctggatgccgccggcttccgggtggaggtggacggccgcaacgagaagatcggcaagaagatccgggaggccaccctggagaagatcccctatatgctggtagtgggcgaccgggatatggaaaaccagaccgtctccgtccgcctgcggaccggtgaggatctgggcgccatgtccgtggcggattttgccgcccggctgaagcaggacgtggacaccaaggccatctggtaaaaatgcgttcccctcacagcggcccggggccgaacccggaccgctgtgtccgattccgcaacgggcgctcccgcatccgggcagcggaaagatggcgggcattttcggtggttctgcacattgccgggaccgcccggacggtatacaatagaaaaaacatccggcactttttgcagaggaggcggctatgagtcaggagattcactatttggagaccggatcccaggaccctttttacaatctggcgtttgaagagacggtactccgcagccggcggtcgggggagtatctgctcctgtggcagaacgacaacaccatcgtcatcgggcagaaccagaacgccgagggtgagatcaaccgggcctttgtggaggcccatcaaatccatgtggtgcgccgcaccaccggcggcggcgccgtgtaccatgatctgggcaacctgaactactccttcatcaccgacgtgggagacgcggagcggctgaccatggagcggttcacccgtcccattgtggaggccttgcagggattgggcctgcaggcggaggcctccggccgcaatgacatcctggtggaggggcggaaggtgtccggcacagcccagcggctgctccgcgggcgcttcctgtatcatgggacactgctgttcgacgccaaccccggcatggtgtccggggcgctgaatgtggacccggcaaagttcgagtccaagagtgcaaaatccgtgcgcagtcggatcggcaacatccgggagttcctgaagacggatatggatatgcccgccttctggagttatctgaagaaaacattggccggcagcggtctggtggaggatcacctgacagatgaggaactggctgctgtggatgagctgaagcgcaccaagtacgacacctgggagtggaacttcggccgttccccaagtacaacctgcggaacaagcgccgctgggacggcggcaccctggagccctgtgtggaggtggaccaggggatcatccgccagatcgtgttctacggagattttctggctgtcagccccatggacgaggtgaccggcgccctgatgggcacgccattccggcgggaggacgtgggggcggtgctggaccgcttcccccttcgggactatttcggaaccatcacccgggaccaggtgctggatacaatattttatgtggactgagacagcgtccgcagaatcaaaaagagagacgcgcccggcgcgtctctctttttgattctgtcaggtcaggatttcccgctggaacggctccagcagcagccggacatccggcaccccctggagctggcccgcacccttgacggcggcatcccgatatccccagcggtcatcgtgggagaaggggagatggtataccaccagatgctccggccggatggcctgttcgatgaagtgacggcccttccgaagagtcacccaagggaagttcaaaagggccagatcaatggggcggttgccgatgaaatcccgcagctgcgggtccgccacggcgcagtctccggcgatcaggacccggaaaccgtcatattccaggatacagccgtagtgggggacctcccggtactgtgcaccctcgtgagtcaggcgcatgaagtccatgtgcagcccctccagggtgagatggctgctgggaccggccagcaccagctggcggtcaaactcctgctccggcagcaccagggccacctgcggattttgggcaatcacctgctctgtcagggcgcgggagtaatggtccggatggcagtgggtgaaaaagagcagatccgggctggcgaagtccggatgagcctgaagaatgttccagcgctcaggggtgacagtggagaaccccacaacccgatggtcgtggagcgcgtcggaccagacccgcatggcacccagatgcagggcgaccccggcgttgacgctgagtgtgatttggcaatgggacatgatgtcgctccttgtgtgtacaggatttttacttgcgggacaaacgtctttcagaataaaatttcaaaatgccatgatttgcgtaaggcttgcgtaagaatcggcgctttgcggttttatggttgattataccatactttttccgaaaaatcagcaaaaagtccaaaaataatttatttttctgttaaaattgccatatttttgctgtttgtacaaaattggcaaagagccacagaacaaaaatgggcaaaatgacaaatttccgattgctgattgatattgaattggcaaagtgatatacttgtctccgttaacagaaatttaatatgtatttctgtgaaacaggcggctttgcggcagtttattcatacggcatgatagacaggcaactattcatgcgcaggagacgtataaatattctgttaagacggggcgccacactaactgaagggattgatcgaatgaaaacctacaagacgatcatgaacgggctcaccaaagtcgaggaattcgtgctctgcgtgattaccgtcgtggttacagcgatcacgtttatcaacgtgctctctcggtatgttttccactccaacttcgcgtggtccgaggagctggtcatcaacgtgttcatcctgatgatcatgctgggctgcgccctagctaccagagacggcagcatgattacgctgtccctgatcttcgacaatgtgggcgtcgggggtaaaaagattctgaccgtgattgacacggtcgtgaacctgatcttttacgccatcctgatctacaccggctttaacaaggtgttcgatcagatcagcaccggcaaagagaccttctctctgggctggcccgaatgggtgtttaccatcctgctgcccatcggctccatcttcctggtgctccatgcgatcgagtatctggtcgacgtgatgagcaacaaggccgcctgtgtgaagccggctgagacagagggaggcaaagagactgtatgattaacttgatcctgttcggcagcttcttcgtgatgctgctgctgaatatccccattgccgtcagcctgggtatgtcttccattttcgccctgctcttcagcagttccccctgacggtcgtccctaccaacgtgtacagcggcatggcaaagttcctgctgctggctattccgttctttgttctgtccggcaacatcatggccaaggcgggcatctccagccgtctggtggcgtttgctgatgactgcgtcggccatcggcgcggcggcatcgccatcgtggctgttatcgtggcctgcttcttcggcgccatctccggctccggtcccgccaccgtggcggctctgggcattatcctgattcccgccatgatcaaccgcggcggcttctccgcccccttcgcctcttccctgatggccagcgcctcctccatcgccatcgtcattccgccctccatcgcattcgtggtgtacgcctccatcaccggcgtctccgtgggcgatatgttcatgggcggctggattcccggcatcatgatgggcctgtccctggtgatcatcatcatgatcgagtgccgcaagaagggcatccaggcatccaaggcaaagtcctcctggggccagcgctggaagtccttccgtgaggccttctggggcttcctgatgcccgtcatcatcatcggcggcatctacggcggcgttttcacccccaccgaggcggctgccgtctccgtggtatacggtctggtggtcggcgtcttcatctatcgtgaggtcaagatgaaggatatgatcgatatcctggtcgactccggcaagaccaccggcggcatcatgctgatcatcggcgcggccaccctgttctcctatgtgtgcacggtgttcggcattgcgcaggcggcccaggctctgctgctggagatctccggcaacaagtacatcttcctgctgatcgtcaacgtgatcttcctgattgcaggctgcttcgtggacgccaactccgccatgtacatctttatccccatcatgtaccccgtagccacccagctgggcatcgaccccgtccacttcggcgtgatcgccacagtgaacctggctatcggccaggtgactcctcccgtgggtgtcaacctgttcgtcgccatcggtgtgtccgagaagcttcagggcctgcgggacaagaccaaggtcaccattgtctctatgtccaaggctgtgtggccccagattgtggcatgcattattgcgctgctgctcatcacctatgtgccctggttctctaccgtgctcttgttcggcaaataagcatctcctgacttggctgtaaccgcgctttgcggtttcagataatacctgctacaactattttaaggaggcaaaacaatgaaaaagtttcttgcactgctcctggcgctcaccatggctctggccctggtggcctgcggcggtggcgatgacgctgccagcgataccactgccgacagcggcgatgatgctgccgcttccactggcgagttcgaggaaatgacctggaagttcgcctgctccgccacggagacctctccctgggtggacggcgccaaggagttcgcccggatcgtgggcgagaagaccggcggtgccatcaccgttcagtactatcccgctgaccagctgaccgccggcaaccagaccgacggcatccaggccctgatggacggtaccaccgagttgtccatgcactccaacctgatctggtcctccttcgaccagcggttcaacgtggtctccctgcccttcctgttcagcagcacggaagaggctgacgcggccctggacggcgccggcggcgaggctctgggcgagattctggagagcacctacaacgtgcacctgctgggcattgcggagaacggcttccgccacatcaccaacagcaagcacgccatcgccagcaaggctgacatgaacggcctgaagatgcgtgtcgcgggttcccagctgctgaaccgctcctatgagctgtggggcgccgactacaccaacgccaactggtccgaggtgttcaccgctctgcagaccggcacctacgacggccaggagaaccccctgcccaccgctgatgccgcttccatccaggaggtccagagctatctgacctattggaccggcgcttatgactgcctgttcttctgcatgaacgctgagctgtacaactccctgtctcccgagctgcaggccatcgttgacgaggccggccaggctgcctgcgagtacgagcgtgagctgaaccgcagccaggatcaggagatcatggacaagtgggccgaggctggcgttgagatcaccgagctgactcccgaggctgctgctgagttcgctgaggcttctgcccccgtgtacgacgagttcgccgacgagctgacccccgagctgatcgaggctttcaccagcgtcactcaggctgatgctggcaccactgagcccgccgcctaattgaagaggcagcctgcgtttccgtataaacaacggttaaggtttcgtaagttgcgttagctgagaggacgtggctgcaggaaactgttgccacgtcttttcagagaacataggtgaaaattttgacgatttcaccgcccagcgcatctgtcccagcaaatttcaaagagtgccgacaggagagtcggcagaagggagtttttcctatggcagcaacaaaggcagcaaaatacaccaaggaactggcggagcacttttatgagaccatgtgcaccatccgcaagtttgaggagagcgtgaagcacgacttcctgaatggtgagattcccggcttcgtgcacctgtacatcggtgaggaggccatcgccactggtgtgtgctccgctctgcggaaggacgatatgatcgagtccactcaccgcggccacggccactgtgtggccaagggcgcggatgtgaaccgcatgatggctgagatcttcggcaagaagaccggcctgtgccagggccgcggcggctccatgcacattgccgacttctctgtgggtatgctgggcgccaacggcgtcgtgggcggcggctacaacctggccaccggcgctgccctggccagcaagatgatcctgaagaacgaccgggtttccgtggtgttcttcggtgacggtgcctccaaccgcggcactttccacgaagccatgaacgtcgcttccgcctggaagctgcccgtgatcttcgtcaacgagatgaactgctgggcttccaccacgccttaccgcaccacctgcaatgtggagaacatctccgaccgcgcggcgggttatcatgtgcccggtgtgatcgtggacggccaggatgtctttgctgtgtatgaggccgccaaggaggctgttgcccgtgcccgtgccggcgaaggccccacgttcatcgaggccaagacctaccgcattgagggccacttcgtgggcgaccctgaactgtatcgtgaccacgccgagacccagaagatctatcacgacaccgatcctctgaagatgttccgcgccaaggccgccaagctgaagctgatgaccgccgaggagtgcgacgccatcgatgccaagtgtgagcagaagatcaaagacgccaaggagtacgctatgcagagcgagtacgccgatgcgtccgagtacatgaagtacgtctacgtggatgactaaggcgaaggaggacaaatacgatgcgtaagatcactttttctcaggccactcaagaggccatggccgagacgatggcgaaagaccccactgtattcgcaatgggcgaggacctggcccgtcagggcggtatcttcggtcagttcaagggcctgccccagcagttccccggccggatcattgatacccccatttccgagacctttatcatcggcggcggcgtaggcgcggctctggccggcgcccgtcccgtggtggacatgcacttcgccgacttcatcggcgtgcccatggacgagatcttcaaccagatggcaaaggtccgctacatgttcggcggccaggccaaggtgcccctggtcctgcgtgcgcccgacggttctgccggcggcggcgctgcacagcattcccagtgcgtggagtcctggttcgcccacatccccggcatcaaggttgtggcgccctccaatccctatgacgccaagatggtgctgaaggccgccatcgagtgcgatgaccccgtgctgtacttcgagaacaagatcctgtacaaggagaaaggcgaagtgcccgagatcggcgaggaggagccttacaccctgggcaaggcccgcgtggagcgtgaggggaaggatgtgaccatcgtgtcctactccatcggcatgaagaatgcccgcggcgctgcggacctgctggccaaggagggcattgaggccgaagtcatcgacctgatcaccctgtctccctgggataaggagaccgtgctgaacagtgtgaagaagacccaccgcctctgcatcgtccacgaggctgtcaagcagggcggcttcggcgcggagatctccgccaccgtcgcggaggaggccatggagtatctggatgcccccatcctgcggtacggcgctcccttctgcccgatccccttcgctcccaccctggagaagatggtgaaagtggttccggaggacctggtaaagggcatcaagggcatgttttaatgcctgttgaaaaggagattttcaagtatggcaactgaagtattgatgcccaagctcggcctgacgatgaccgagggcaccattgaagagtggaaatataaagagggcgacgctgtcaagaagggggacatcctgttctccgtagcgacggataagctgaccaacgacgtggagtgcgaagaggacggcaccctgctgaagatcctgctgccggagggcgagaccgccccctgcaagagcgtgatcgcctggatcggccagcccggcgaggcgattccggatgcctccggtgccgccgcgcccgccgcggccgcgcctgctgctcctgccgctgcgccgtccgcagcctctgccgcggctcctgccgccgcccccacggcccatgcggaccgtcccgccggtgcctacgtgctggcgactccctacgccaagaagctggcgaaggaaaagggctatgacctctcccagatccccggcaccggccccaacgggaccgtggtggccaaggacgtggagaactttgtggccggtcccaagaccagccccatggctgccaagctggctgccgagctgggcgtggacgtcagcaagctggacgtccagggccgcgtgatgaaggcggacgtgctggccgccgccggtgtgggtgcagccgcagctcccgccgctgaggccgctgccgctgttgagagcaacgacgagaagcctgtgaaggtgaatccgctgcgccgcagcatcgctgccaacatgaccaactcctggcacacctctccgcgggtcacctacacccgtccggtggaggtcacggctatgaaggacctgcgggccaagctgaaggacggcctgaaggagcaggggatcaagctgacctacaaccacatcctgatgaaggtggttgccaaggccctgaccgagttccccgacgtgaacgccagcttcgcggacaatatgctgacccgccacaagcacgtgaacatgggcctggcggtcgccaagggcgatggcctgatcgtgcccaatgtgaagaactgcgaggagaagtccctggcacagatcgcccaggagacggaggctctgatcgaggccacccgcaccggcaagctgggcatggaggacatgaccggcggcaccttcaccatctccagcctcgggccctatggcatcaccagcttctctcccatcatcaaccagcctgagctggcgattctgggcgtgtgcgacatggtggatacccctgtggtgcgcaacggcgagatcgtgatccggaccatgatgaacctgagcctgactgccgaccaccgcgtgatcgacggcgtgatggcctccaagttcctcaagcggatcgcggagctgctggagaacccctacatgctcctggtgtgagatcaaacaacccattcaagggaacccggcctgtgccgggttccctttgaggggtcattgtccaaaatttgacgatccaaacaactcaaaggccgaattagaggcggtttttgggtaagttcatgaaagaaggacagaaattatggcaactgaagttctgatgcccaagctgggtctgacgatgaccgagggcaccattgaagagtggaagttcaaagagggagacaccgtcaagaagggggacatcctgttctccgtggcgaccgataagctgaccaacgacgtggaggccgaggaggacggcaccctgctgaagatcctgctgccggagggcgagaccgccccctgcaagagcgtgatcgcctggatcggcgccgccggagaggcggttcccgatgctgccggcgccgcggctcccgccgcacccgctcccgccgctcctgctgcacctgccccggctgcagcccccgccgcagctggccagaagaccgttatcgtcgtgggcggcggccccggcggctatgtggctgccatccgggcggcccagctgggcgccaaggtgaccctggtggagcgcgagcacatcggcggcacctgcctgaacatcggctgcatccccaccaagtgcttgctgcacagcgcggagctggtgtccgagatcaaggaacagggtgctgacatcggcgtgaaggtctccggtgtggaagtggatttcccccaggtgatcgcccacaagaacgccatcagcaagcagctgacccagggtgttgccggtctgctgaagcagaacaaggtcgcccgcgtggacggcgaggccagcttcaccggccccaagaccctctctgtgaagaagtccgacggctccgtggaggagatgaccgccgacgccatcatcgtggccaccggctccgtcaacgcccagccgcccatccccgggctgaaggagaatcccaactgcatcgactccaccggtgcgctgagcctggagaagctgcccaagagcatggtggtcatcggcggcggcgtcatcggcctggagctggcctgcgcctacgcggccttcggcaccaagatcaccgtggtggaggcactggaccacatgctgcccatgctggacggcgacctgactgccatcggcgtgaagcacatgaagaagatgggcatggagttcaacctggagtgcccggtgcaggccgtggaggcctctcccgtgggcgccaaggtggtctgcaagaacaaggccggcgagaccgtcagctttgaggcggagaaggtgctggtggccatcggccggaaggccaataccgccagcctgaacctggaggctgccggccttgccaacgaccggggccggatcatcgtcaacgacaagatggagaccagcgtgcccggcgtgtacgccatcggcgactgtgtcttcggcaaggcccagctggcccacaccgccagcgccatgggcgaagtggctgcggagaacatcatggggatccctgccgtgtatgacgaaaagaccaaccccacctgtgtgtatatggagccggaggctgcctctgtcggtctgaccgaggagcagtgcaaggccaagggcatcgactacaaggtgggcaagttcccgctggtggccaacggcaagtccctcatcatcaatggcggcgagggtctggtgaagatcatcgctgacgccaagtacgaggaagtgctgggtatgcacatcatcgggccccgggctacggacctgattgccgagggtgctctggctctgcggctggaggccaccgtggatgagctgatctccacgatccactctcatcccacggtttccgagtccgtgcgggagtgcgctctgaacgtccagaagcgcgccatccacatcaagaactgattgcgtttcccgatgacaagggccgccgctatcaagcggcggcccttgttgctgcgtgaagaacggtatggtgcctaaatggcgcggcaaaactccagtgtgcagtccaggaggatataaatgcgggaagcccccgtatacctccagatttgcctgacagcgtaacaggaatacagcgtgtggagctgcagggggtactgtaccggtcgggaaagacggggcgtttcattttctcctttgcttgtccacgccgatcttttatgagaaatgccgatcaggagatgcacgctgaacgctgaagcatgggatgaggcggggggattcaactgtcatgttcacgcttttctggcatatacctgcctgtcgttatggttatatcataaatagagtgaagatattgcgcatgttttgcatctgatacatttcaccatggagaaacgggaggaacggccttgaagaagcggagaaatcccgctataatggggtggcatgaacggacaaggagggcaggagaccatggcggtgaccggacggtttgcgccgtcgccaagcgggcgcatccatttggggaatattttgtgctgcctgctggcttggctcagcgcccggcagaagggcgggagagtgatcctgcggatcgaggatctggatatcgcgcgatgtccgcggcgctatggggagcagatgtgccgggacatccagtggctgggactggactgggacgagggacctgtcatcggcggccccagcggcccctatgagcagagccggaggacggcgctgtatcaggctgctctgaggcgactggaggcccaggggctggtctacccctgcttctgtacccgggcggagctccatgccgccagtgctccccaccgggaggatggacaggtggtctacccggggacctgccgcggtctgaccgcggagcaggcggcagagcgggcccggcgcacaggccgcgcccccgccctgcggctgtgggtgccggaggaggagatcactttcaccgacggccacatgggggagtacagggagtggctgcctgcggactgcggggattttctgctgcggcggtcggacggcatatttgcctatcaactggcggtggtggtggatgacgcggccatgggcgtcacagaagtagtgcggggggcggacctgctggcgtccacccccagacagctgctgctgtatcggctgctgggactggaggcaccggcgttttaccatttcccgctgcttctgggaagcgatggacagcggctcagcaagcggaacgcggatgcagggctggacacgctgggagagcggtatacggcaccggaaatcctgggaaagctggcatatctcgcaggcttcaacccctcggcagaacccagaagcggggagagcctgctggaggactttgcctgggagaaggtccccagagcggatatccgcattccggagggactgttttgaaaaggaagcggcacaggctgacagcctgtgccgcttctttagttgctttgtcccgaaagggcgtctggaatctccacttctgccatcagctcccggctgatgatggtgagcatctcctccagcttggcgcactccgccggggtaaaccgctgcgtgatgcggttcatgacggcggtcatgtaggccgtgctgatgttgtagtagtcgatatacttctgagtgatctccagatggtattcccgccggtcgtcggaagactggaccttgcggatgtagcctttcttgatgaggctgttgaccttgtatgccgcgttgggaggggagatccgcatgaaggtggcaaattcattcaccgtgggactgcccagagcctgaatggcctccatgcagaaggtctccaccgtcgtcagactggcctcacgatcctgaaagcggctgaagatctcctggtaaaagtgcagcttgaacttggtgtacacgttaaaaaagcgtctttcagcatggctgcaagccctctttcccgcgccttgcccgcatggcgggaaagcgtcggctgtcattccgcaccgatggcgaaggtcagttccgccgtacaggccagttcgccgttgaccgtggccttgcactcgccgatgcccaccggcccgcggcgcttggtgagaacgcactccatttccagcacgtcgccgggggtcaccttccggcggaagcgggcgtttttcacgccgccgaacagggcgatcttgccctggttctccggcagggagaggatggccacggcgcccacctgggccatggcctccaagatcagcacaccgggcatgacgtgctcctgggggaagtggccgcagaagaactgctcattgacgctgacgcacttgcggcccttggcccactggccgggctcgtaatcggtgatccggtccaccagagcaaaggggaaccggtggggtaggatctgcgcgatctggttggaattcaattcgtttgccatggtctcacgcctcccatcgtttgaacagcaggctgccgttgtggccgccgaatcccagagagttggacatggcgtagcgcacatcggcgctgcggccgtgacccggcaccacgtccaggtcgcaggcgggatccggcacctgatagttgatggtggcgggaagatagccgtcatgcagcgccatggcgcagaacatggcctccacagcaccggcggcgcccagcatgtggccggtcatggacttggtggagctgatggccagcttgtaggcgtggtcaccgaacacagtcttgacggcggccgtctcgccggcgtcgttcagggggtggaggtgccgtgggcgttgatatagtccacatcctccggcttggcgccgccgtctgcaagggccatctccatggccttggcggccccgctgccgtcgggccggggagcggtcatgtgataggcgtcgcaggtggcgccgtagcccacgacctccgcaaggattcgggcgccccgggccttggcgtgctccagctcctccagcaggaggatggccgcaccctcgcccagcacgaagccgctgcgctccgcgtcaaaggggatggaagcccgcttgggatcgggattctgggtcagggccttcatggaggtgaaggcgccgatggccagaggtgtcacagcggactccgtgccgccgcagagcatcacatcagcataaccgtcccggatatagtggaaggcatcgcctacggcattggtgccgccggtacaggcggtcaccggacaggagcacatgccccggaagccggtgtggatggcgatctggccggcggccatgttgcagatgccggtggggatatagaagggagagacccggtcccagcccttctccttgcccttgtcgtgctctgcctccgtgatggagaggccgccgatgccgctggagacaatgacgccgcagcgatccgcctccgcttcatccaacgtgaagccagcaccgtccagtgcctccttggcggagacgacggccatctgggtgaagcggcccatccgcttggcctctggcttgctcatgtagttctccggcacgaagcccttgacctccgcggccagatggaccttcagatcggtgggatcgaattgggtgatgggagcgatgccgcacacaccgtccttcacagcctgccagctctctgccgcggtaaggccaatgggggtcacggcccccaggccggtgatcacgactctccgtcgttccatagtatacctcctgtagatagagttgggagcacccggaaaaggtgttccaaaaggccccgcaaaaggaagggggctggggaaatccattcggggttccccggttgatctgccagaggcagatcaagaaattccaatcattttcggcagggcgcaccccagggcggcttctcttgcccctgcggggcaattcaccttctgtacctgccgaaaatactttgacccaagccgctgaaagcggcgcagaagtgcccttggggtgcagactggtgatgggggttcagcggagccggtggcataccggcggagcgtccaagggggacactgtccccttgaatgcttcacatcgccatgcccccgtcgacggccaggacctggccggtgacataggcggcctcgtcgctggccaggaaggccacggcctttgccacatcctccggtgcacccagccgctgcatagggatggtgggcatcatggcgtccttggcggcctggggcatggcagcggtcatgtccgtctcaatgaagccgggggccacggcgttgaccgtcacgccccgggaggccagctccttggccagggacttggtcatgcctaccacacccgccttgctggcggcgtagttcacctggccggcgttgccccggaggcccaccacgctggagaggttcacgatccggccgtaccgctgcttcatcatgattcgggacacggccttcatgcacaggaaggtgcctttcaggttggtgtcgatcaccgcgtcgaagtcggcctccttcatcatcatcacaaggccgtcccgggtgacgccggcattgttcaccagaatgtcaatccggccgaattccttcacagcggcatccatcagggccttcacctgggcctcgtccgccacgttgcactgcacggccagggccttggcacccaggtcctcgcaagcggtcacggtctcctgggcagcttccgcccggccggcgtagcacagcaccacattggcgccgccccgggccagctcctcgcagatggcccggccgatgccccggctgccgccggtgaccacggcggtctttccagcaaaattcatcatgccttctcctttatcagttgttccagcgtgtcgggcaggttctccacatccgctgcggtctccaccgcgcagaccggtatgccgggaacggtctttttcacaaaaccgctgagggctttgcccgggccgatctccacgatggcgtccacgcccatgtcggccatcttccggatggagtcctccatgaacacgctgctctgcacctgcttcaccaacagctcctggatgggggtgctgtcatccttcacatcccccaggcagttgaagatcacggggatctggggatccgcaaacgccacgccctggaagtattcccgcagggcattcccggcaggggccatcaggggggtgtggaaggggccgctgaccttcaggggcaggcaccggcgggcgcccttctccttggcaatggcggcggccttctccacagcggccttctcaccgccgatgaccagctggccgggacagttgtagttggcgattaccacgcaccccaggtcagaggccgcgtcgcaggcatcctgcagggggctgcggtccagattcaggacggccatcatggcgctctcccggccggcagccgcctcctccatggccttgccccggaaagccaccagacggatagctgtggcggcgtcgaacacaccggcggcgtgaagggcggagtactcacccagggagaggcccgccgccacagcgggggtgatgcccttctcccgcagcaccgccgtcataccggcggcaaaggccaccatgcagggctgggtgtagcgggtctggttgatgatgccgtccgggtcctcaaaggtgaccttcttcaggtcaaaatccacttccgcatggtcgtaaacagcccggaaagcggaaaacgcctcgtacagatcggcgcccatgccggcatgctggctgccctgaccggcgtacaaaaagcccagtttcattctgcgtcgctccattctgcggcggtggccttcgcccgtgcgataccgctctcatacagatcacggaaaatctcggccacgggccggatctcgtggagcataccagccacctggccgctcatgacgctacccatttccacatcgccctccagcacggcccggcgcaggccgcccagggtgaccttctccagctcctccagagaggcgccgcgcttctccagggccagatactcccgggccatcttgttcttcaggattcggaccgggccgccgatggagcggccggtgaccaccgtatcactgtccttggccttcagcacagcctgcttgtaattggggtggatggggcactcctcgctggcaagcaaacaggtgcccacctggatgccgcaggcacccagggcaaaggccgcagccgcctgacggccgtccgcgatgccgccggccgccaccacgggaacgcttaccgcatcgatgacctggggcaccagggccatggtggtcatctcgcccacgtggccgccggactccgtgccctcggcgatgatggcgtccacgccatagcgatccagccgcttggccagaaccgccgccgccactacgggcatcaccttgatgcccttttccttccaggcgggaatgtacttgccgggattgccggcgccggtggtgaccactttcacgccctcttccagaatgatctgggcgatgtcgtcggcataggggctcatcagcatcagattgacgccgaagggcttgtccgtcagctccttggcccggcggatctcctggcggagacggtcgccgtcccagccgccggtggcgatcatgcccagggccccggcgttggagcaggcggcggcgaactcgccggtggcgatgttggccataccgccctggataaaggggtacttggttcccaggatttcattgagctttttcataaaaatctcccattcgccgctgtgcgcggcctaaataaagctgaagttttcgccggtaacaggcttgcgtccagagcgcctgcttgacgtgcagggagtcaggcgaactccaccagggcgccgccccaggtgaggccgccgccgaagcccaccaccaggacccgggagccgggccccacctttcccaggtcatggagctcactgatgaccagggggatgctggcggcggaggtgttgccgtatttctggatgttcttgtagtacttctccggggggatgtggtactttttggctgccaggtcgatgatccgggcgttggcctggtggaagacgaagaagtccacgtcctcaatggccatgacggccttttccagcacctggtcgatgcagtagggcactgccttaacggcgaacttgaaggtgggctggccgtgcatgaagatgcgggccggcgccggcttctccgcgccggtgacgcccagcatgtccgggtcgccgtggcagcccagaacggcgtggatggagggatagtcctcccgccactccaccaccacagcgccggcgccgtctccgaagaggacgcaggtgccccggtcctcccagttgatgaaccgggagagcatctctgcgccgatcaccaggccgtacttccggggggcctgggccagcaggcactccatggtgtggatggcgaacaggaagccgctgcatgcggcattcaggtcaaagcacaccgcgtcgtggggcagccccagcccccgctgcaccatgcaggcggcagagggggacaggtagtcggaggagaaagtggccaccacgcaggcgccgatgtcctccggggaaatcccggcgttttccagcgcctgccgggcggcgcccacgcacatatccgtgtgggtctccgtggtgcagtggtggcgggtctggatgccggtgcgggtggtgatccactcgtcgctggtatccacgatttttgccaggtcgtcgttggtgacgattttcgcaggggcgaaccggccggtgcctctgattttgattccgctcatgcttcctccttctggggtgctgcgcccatgcgtctgaatttttgataccggcctgcggccagagcggctccgctctctttggagagctccgccaggcagcggctcagagcccgatccacctgccgcatgtgggcggcgggagccagatgggcgccgccctccggctcagggatgatgccgtcgatgacgcccagctccagcaggtccggcgccgtcagcttcatcagctcacaggcttcctcatgtctggcggagtccttccacagaatggaggcgaagccctccggagagaggatggcgtacacagagttctccagcatcagcacccggttggcaacgcccaacgccagcgcgccgccgctgttgccctcgccggtgatgagggcgatgacggggacggtgaggcggctcatctcatagagattccgggcgatggcctcgccctggccgtgggcctcggcctccaggccaggataggcgccggaggtgtcgataaacgtgaggatggggcggcggaacttctccgcctggcgcatcagccgcagagccttgcggtacccttccggattgggcatgccgaagttgcacttgaggttctcctccagcgttttgcccttccgggtgccgatgacggtcacagggcggccgtggtacagggccacgccgcccaagatcgcggcatcctcgccgcagaggcggtcgcccttctgctcaaagaagtctgtgaacagcgcctgaatataatctgtgatattgggccgctgggggtggcgggcaatggccacccgctgggcggcggtcagcggttcgctcatgtgcgtccccctttctcatggagccgcagcagctgggacagggtgtcccgcatctgaaggcgcggcaccaccgcgtccacaaagccgtgctcctcctggaactccgcccgctggaagccctccggcagggtctggccgatggtctgctggatgacccggggaccggcaaagccgatcagagcgccgggctccgccaggatgatatcgcccagagaggcgaaactggcagtgaccccaccagtggtggggtccgtaaagacggaaatatacaaaagccctttctccgagaagcgggccagcgccgcactggtcttggccatctgcatcagggagaggatgccctcctgcatccgggcaccgccgctggcggcgaacaggatcaggggcaggcggttcttggtggcgtactcaatggccagggtgatcttctcacccacggcggcactcatggagcccatgaagaagcggctgtccagcacacccactacgcatttgcggcccccgatggtgccggtggcggtgaccacggcctccgtcaggccggtcttgcgctgggcggcctccaccttggcccggtagccggggaaggagagcgggtccgccgcaggcagcttttcaaacagctcccggaaggagccggggtccagaatcgtgctgagtcgatagtaggcgccgatggggaaatggtagccgcacttggggcagaccgacaggttctgcgccacggatttgcggtcgctgtcctgcccgcacttgggacaggtgatggctttatcgccgggaatgtgattgtcccggatggccttcatggccagcaggcgcgcccggcgcttggcgaagacgccgttcatcccactcatgcatccaccccgctttcactgagcttgcggctgaattccagcagctccgacaggtgttcatccaggaaggcagtggtgcactctcccagaatgaactccggatggtacagaatctgataggagagctccgcattggtggggaagccctccagagtgaactcctccaggcagcggcgcatccgccggatggtctccatccgagtgggggcgtaggccaggatcttggctgccatagagtcgtagtaaggagacagctcgcacccgctgtacaggcaggagtccacccgcacgccggggccgccggggaaatggaggaaatccacccgtccggggcaggggcggaacccctgcacagggtcttcggcgttgatgcggcactcgatggcatggccctggagcgtcacatcctcctgccgcaggcgcagcgccaggccggaggcaatccgcagctgttggcgcaccagatccacaccggtgaccagctcggtgacgccgtgctctacctggatgcgggtgttcatctccatgaaatagaaatgctcccggtccgggtccagcaggaactccactgtgccggcattctcatagccaacggctttggccgcctttacggcggcggcgcccatccgctcccgcagctccggcgtcaaacaccgggcaggggcctcctcgatgagcttctggttccgccgctggaccgagcagtcccggtcccccagatggatgacgttgccgtagcggtccgccagcacctggaactcgatgtgccggggccggagcaccagtttctccagatacatctcgtcattgccgaagcaggcctgggcctctgccttggcctccgcaaaggccgcggacagatcctccggccggtcgcaccggcggatgccccgcccgccgccgccggcggacgccttcagcagcacaggatagcctacggactctgccgcggtcagcgcctcctccacagaggcgaccgggccgtcggagccgggggtcacgggcacgccggcggcgcgcatcaggtcccgcgcggcagatttggagccggccttgcggatggcgtcgccggaggggccgatgaaggtcaggccagctgcggcgcaggcgtctgcaaagtcggcgttttcagagaggaagccatagccgggatggacgccgtcgcacccggtggctttggccaccgtcagaagagcatcctgattcaaatagctgtctgccgcccgggcagggccgatgcacaccgcctgtcccgccagctggacatggagcgcgtccgcgtccgcctgggagtatacggccaccgtctcgatccccagctcccggcaggcccgcaggacccgcagggcgatctctccccggttggcgatcaatacccgcctcagcatggccgataacggaacagcggctcgccgaaggccaccagctcgccgttgctcttgcacacgctctcaatgacgcagtcacagggagcgggaacttcgctcatcatcttcatagcctcgatcaggcagacggtctggcccttggacacccggtcgccgggcaggacaaagggggcctggtccggggcgggcgccgcgtagaacgtgcccaccagaggcgcgtcaatagaggaggagctgctctggggcgcaggcaccggagcagcggcggcagccggagcggccgcaggtgcgctggccgcaggcgcagacgcgccgccacgggtcagctctatggtgaactcctgcgtggacagcttcatcgtctgagcggtgctgcggtcgaagcaggcgacaatctcaaaaaactcttggttggtcatagcgcattcctttctcagcggaaagtgaacccgccggagggcgcgggcccgccggcggggcagggattactgcttgtgggcgttcaggtagttcatcacgtcgccgacggtcttcatctccgccagggcgctatcctcaatggagatgccggtggcctcttccagagccatcaccagttccacggaagccagggaatcagcacccagatcgtcagccagggaggcgtccattgtgacttgctccgcgtcgcagcccagggtctccacgatgatatcacgtacttgctcgaattccatattggtactccttatgtcgaaaaatgatgaaattattttaattaaaataatttaactaaaataatttcacgttgattttatgcggtttatgccggtttgtcaagtaaaattttggagaacgcccgccttctccgggacgtggcagccgcaccttatttaattataaggaagacagcgcctgccgcagcgcgtcgtcgctggcggggacgccccagaaccggagtgttccattgatctccagggcgggagtgcagagggtctccggatgctcactcgtcacctgttcgttcagcacccggcagccggggcagtaggcgtacaggcagggcatcagcaggtccatccggtcgatcacatcgtcgtctgtgattttctccagagtgtagtccaggccgagaccgtcggcaacggcccggatgcggtccatgtagaagtcgttccgggcacagatggaacagtacaggcgcagtttgacaggggtgctcatttcatcgtctccttattctccgggcggggcccatattccgcagaacagcataccacaaggggaggcagggggaaagacggcgtcctattttttggagatttgacgaaaaagatatttgcttttgccgatatatccgctataatgtgggaggattgcgccggaggatccccaacggaacctgtcccggcggaagaaaggatggaggaccgcatgaagatcgtcattgtgggcgcgggcaaggtgggcgtggccctgacgcgccatctggccgtggagaacagggtcacagtgatcgaccaaaatccacatctggttgagaacatcatcaacatctatgatgtgatgggcgtgtgcggcaacggcgccagctacgatgtgcagaaggaggcggatgtggagcaggccgatctgctgatcgccactacctccagcgacgagattaatatcctcacgtgccttgtggcgaagaaaatgggtgtgcagcacaccatcgcccgtatccgcagcccggaatacggccgccagctgcggtttatgcgcagtgagctggggctgtccatggccatcaatccggaggcggcaacggcccgtgagatcgcccgtgtgctgcggttccccaccgccatgaagctggagtccttctccaaggggcggctggagctggtggagtaccgggtggcggagcacacggccctggacggcacccggctttcggaactgtaccggaatttcaaggtccgggtgctgatctgcgccgtggcccggcagggggagacgatcattccctccggcgatttcaccttgcgggcgggagacaagatctatctcaccgccgcaccccgggaactggagaagttcttccggcttctgggcgtattccgggcccgggcctcttcggtcatgatcgtgggcgccagcaaaatgtgctactatctggcatctgagctgctggagatgggcatgtccgtaaagatcatcgaccaaaacgagcagcggtgcgtggagatgagcgagaaactgccccgcgcgctggtgatcgtgggagacgggacggacagcgagctcctcagcgaggagggaatcagccagacggacgccttcgtggccatcacgggcctggacgaggccaacatcctcatggcactcagcgctgccaagcagtccggcgactgctgtaaggtggtggcgaagatcaaccgcaagtccctgctggagctggtctccaccgagagcctgatcgacagtgtggtgtccaccggtgcggtgaccacagagctgatcctccagtatatccgggccatgaagaacgcctccgcctccaaggtgaaaacgctgcaccgcatcgtggatgagaaggtggaggctctggagttcagcgtgacgccggacatctccttcgccggcgtgcccctgcgggatctgaatctgaagcggggcctgctactggcaggtatcgtgcggcagaacgggcagatcgtcatcccctccggcaatgatgtcctgcacctccacgacgatgtgatcgtagtgaccacggacacccagctggaggatcttcgggatatccttgcagagtgagaaggcaggtaagttctgtgaattatcgaatgatcggctttgccattggccgtatcctgctggtggaggcggcgctgctgctgcttcccatggcggtggctctgggatatggggaatcccctgtcccgtatctgctccctgcggcgctgctggtgctgtgcggaggattgctgagcttcaaaaagccgcggcaggcgtctctgttcgcacgggacggcctggcggtagtggcgctggcgtggattgccgtgtccctcttcggtgcgctgcccttttacatctccggctccatagagagctttgtagattgcttctttgagacagtctccggcttcaccaccacgggggccaccatcctgacggaggtggagtcgctgaaccggggcattctgttctggcgcagcttcacccactgggtgggcggcatgggtgttctggtgttcgtcatggccattctgcctatgggcggggatggccacgggatgcacatgctgcgggcggagatgcctggacccgcggtgggaaagctggtgagccgcatgagcgacaccgccaaaatcctctacggcatctacctggtgatgactgtcattgagatcgtgctactgctggcgggcgggatgccgctgtttgacgcctgcatccactccttcggcagtgcgggcaccggcggcttcagcagccggaatctcagtgtgggagcttataacaacccctattttgaaattgtgatcggcattttcatgctgctcttcggcatcaatttcaatctgtattacttcctgctggtgcggcggttccgggacgtgttccggtccgaggagctgtgggcctatgtcctcattgtggcgacggcagtggctgccatcaccctggatatcgtgcacatgtacgagtcggtgggcaccagcctgcggcacgcgtttttccaggtgtcctccatcatcaccaccaccggttatgccacggtggatttcaacacctggcccaccttttcaaaggccattctggtggcgctgatgtttatcggcggctgcgccggttccaccgctggcggcatcaaggtggcccgggtggtgatcctgcagaaggtgtctgtcagcgagatgcggcggatgctccaccccaatgcggtgcccgccatccagttcgagggcaagcccctgaacgagcggagcatccggggcgtccatctgtttctggcggtgtacctgatggtcttcgtggcgtcctgcctgttggtgtctctggagcagttggacctggtgactacgttcacagcggtggctgcctgcatcaacaacgtggggcccggtctggagattgtaggtcccatgggtaacttctccagcttctccccttggtccaagctgctgctgtccttcgacatgctggtgggacggctggagatcttccccatgctgcttctgttcgccccttccatctggaaacggcggctgccgtcccgcaggctggtggactgacttgcctgaaaatcaaatccaacggaacaggaccgccgcggagatctgcggcagtcctgccgtcctgtcaagcgcccgccgccgcggagggcgctttttttctgcggtggggggaaattgccgggcagcgcgggacaacggccaccggcaaccgcgtctccaaagctgcccgccccaaacagaggaatatgtttccccggagcgccgccccaccggcaagcggacaggagggcctgcgggacgctgtgagcggcgtcccgcgggatgggcttcgggcatcacggcggctaaaggatcggctgacggatacgaagaggaggcaagtagacggcggcatccggacagaggcgggctctggagagacgcccggcccggatcctgatgggcgagaagaagctgcaccccggcggagctgtggaatcaaaagagcggggccccggaggacaatggcaaaacctccggggccccttgaagggattggacaggaatcgtttcaaaacagaacgctagcggatggggttggagatgcgaccgatcccgtcgatctcgcaggtgaccacatctccgcgcttgaggaagcagggggatccattcccatccccactccggcgggggtgccggtgatgaggatggtgcccgccggcagcgtcatgccctgcgagagctcactgacgatgtggcggatattgaagaacacctggtccgtcacgctgttctgccgcagctctccgttgacaaagcttctgatggatagcgcgggcgggcaggggaattcgtccgcagtgacaatgaccggccccatggcaaaaaaggtatccaggctttttccgaggaagttctgcttgtggcggtactggacgtcccgggcgctgacgtcgttggccacgctgtatccgaagatgtagtcgcccacatcttcctcccggacatggagcgcgtccctgcccaggacaacggccagctccacttcataatccagcttggagacaaaatccagatggccgtcgatcgcctccccatcgcccagggcccggaggacatccgccaggcgcagagcctgccggcttccagcgagctgtatctgcgcccaatggacaagctcatccagactgccggcagttccgcgctgcccgttctgatccaggggcggtggggacccacaagggcgtggtggcccgtcgcattcacaccaaaagcgccacggaggggaccacgctgatgcgcctgcagtgcagggacctgacggagaaaaactgggacatgctgttgaataatgccgcgtctcccattcacgccacgggatacacggtatatctggaaaacgtggatacgctgccgaaggatctgcagcagcaggtggggacctatattgaggataccaagatgacccaccgccatcgggtaatcagctccagctgctgcgacctgtctgccgaggtggcccggggacagttctccagccggctctatctgcagctcagcggattcaccatcaatgtgccgtctctggcccagcggaaggaggatattcccgcctttgtcaatatgatgattccccagtacaataccgcgctggccaaatccaccgtgggcatggagccggatgccatggagctgatggtggaatttgagtggccgctgaatctggtgcagctggaaaaggtgctgcgccagatgatcgcggcgtcctcgggattttatatcactgccgctgaggtggccgcggtcctgcagaacgagatgcggaaagtgagtgcccttccgccggcggtggatctctccgggaccttggaggacatcgagcggagagtgatcgaacaggtgctgcgggaggagaacatgaatcagtccgctgcggccaagcggcttggaatcggccgaagcaccttgtggagaaagatcgccggcagcggcggaaaataaacaaaaaggtccgggggcacagggaatatccctgtgcccccggaccaaatttccggcagcgcggaagcttcacttgccttggattcccagcgcgcggcagacgctgcggcgggtgatgcggtataccccatagagcaccgccgaaagcacggcgatcaccgcagcacagacggccatgccggccatctcgccgggggtgaagcggttatcattgaagtacataatcatgaggtagaaggcggagatgactgccgtgcccacgatggcgggcacaagaaacaccttggacacctgcccctttacggaccggaacagatagcggttcggcgcccccaggtgccgcaggtcgtcgtacacccgtgcgttggtgagggcgatggtcatgcaccgggtaaaggcaatgacgatgaccgccgcgaagcagatcagggcgataaagatgaacagcaccaaaaacaccgccatggtggtgacgaagtcgttctgatccagcacccggaactggggcatgtagagccagtagttgcggaactccgaggtgtcccggtcctcccgctctatcaccgggaagccatgggcggcgatatgtgcccggtcgtagtcatagacctcgccggcctcctccgccagcgccgcacttaccaggtcgtaggcgtacatctgcagcacatcgtcgccggagcggtccacgatctcgttgaacagggcgtcggcaaagggatagctggcctccgcatccgccacgttgaagaatacccaggtctcccgccagaggtcggtgagtccggcggtgaggatctcgtagtcggcgtcatccagcacgtagcagcccagcagcatggtgaaacacagaggctccgccggggtaacggacagactggccccggtgaccatattggtgaccagcgtcacgtcgccgccggagaggtagtcgctgccgccttcatcatccagcacattggcacaggtgccgggggccaggtccacagcttggccggtgagggcgttccaggcgctctcggaaaaataggtggccccgccttggatctcccggtattccttggtgtaggtggtgcccagagctccggcgctctgctcgatggagacggtgccgtcacagcccagggtggcggcgtccacctgggtccaggaggtgatgtcaacaccatgcttcgacgccagagattccacctcaccccgctccggccagttctgatcattccgccagtggtactcgaagtccaccggccgggtggagaagctgtaagtggagctggtattcagcatgggggcgtaaaaggaggcgaaataggcaccggcgatcagcagcgtcatcaccagcatgttccgcaccgtctggcggccttggaacttcatcatggacgtggcgatgatgtcccggtatttatggcgcttccgccagccgttcaccaccgtgtggagcaggatcatgtacatgccgaccagcgccggcaggtaaaagacggcctccaccccagaggggggataccactggagaactgtgacaaagaacgacggcatcagataccccgccagggcgccgatcaccaccaggacgatgcccacgcttccataccaccgctttacctcgcggataggctcggacttgtgggactcctggacgatgtcgatgatgttggtgcggcggatggaccggccgcccaggaagaacagcatccccaccacgtaggcggcaaagaccatggacagcagataggaccggggatcgaaggacagggccatctcctgggagtccaccaggaacaggcggaacagctgccacacgccccaagccagagggccgcctaaggccgccccggcggcgcaggagcccagggagatcaccgccagctccttgcccatctcccgctgcagctggcggcgggtggcccccagggccaggaacacgccggtctcccgggacttctgccggaagaacagcccggcggcataggcggtgaacacggcgcagccgatgaccgccagaacgaacaccatcatcacctgcttgcggctgtcgccgccctccggcaagacggagaggatggtgggggagcgcatcatgcagacataggcagtgatcagcagcacggagaagaagctgcaccctgccagcaaggcgtactggcccctgtttttgcggcgcagggccgcgtaggcgtcggaaaagtgccgcatggtctcactccttccccatgtcccggatggcgtccaacagctggtcctgaaaggcggtgcggtccgtggcgcccttttccagggtccgccacaccactccgtcccggaggatgaccacccggtcgcagaaggaggcggcaaaggagtcgtgggtcaccatgaagatggtggcctccagggattccttggcctgttcaaaggagcgaatcaccgcccggctggacttgctgtccaggttgccggtgggttcgtccgccaggatcagcaggggatggttgatgagcgcccgggccacggcggtacgctgcttctcaccgccggagatctccgccgggtatttgtcccggatggcggagataccgaatacatcgcacagctggtccgcccgggcctccgtctggccggtgacggcgccgccgatgatggcgggcaggagaatgttctcccggaccgtcagaccgtccagcagcaggaagtcctggaacacaaagcccagctgccggttgcggacctttgccaaagcgtcctcgctgagatttgccagctgccgatcccccagcatgatctccccactgtcgatggggatgtagcaggagatgcagtttaagagcgtggtcttgccagagccggaggggcccatgacagccacgaactccccttctccaccgtgagggacacgcccttgaggacttcataggtggtcttgcccacttggtaggatttgtgcagatctttgactgttaacataaaactcttcctttctgtctcacaggatattccccgccagggcgatggccgccagatgggcgggatagaaggcgtagaagaaccagcggttgatcttgatgcgggagtgcgtggcgcagaagatcaggggcgcggcgaacacggcgaaaatggaccagtcgatgcagaggccgcccaccgtcaggcacaggggatcctccggccagccgttcatcagggccggaagataactgaggaggtagagggccgcgcccaggcggggccggttccggcagaggtagaaaatcagcatcagctggatgccggtgccggagtaatcgaagttccaccagctgacggtgaagagcgccagggcgaacagccaccatttccgttccttcaggccgtacatgcccagcaggctcaggaacagggtgaagaagatgttccagttggtgaggttggcccagaattcgccgaccgggtggaaggccaggatgtaaaagggctggctgacgagggcgaagatgcccagccgggtcaggtacttccgcacgtcgtgggtgtacagcaggcccaccgtcaggcagtagcagaagatagggaaggccagtcggccgatccagcggaacacgcccacctccgggaaaaaggcgccgccgatgtggtcgatcagcatggcggcgatggcgatgagcttcagcagatccgtgtccagattggttttcagccgtggccccgtctgggggatggcggcgggagtggtgagcacgctccacacacgggagcgggagatggcagtggcgtttgtcatggtgtttccctccttgttgacaccagcgtaccgcgaaaaaagagccgccgcaaacgggggtgtcatctgcggcggcctggatgtcaagttttgcgttgggaggggaggggatgtcaagtttggcggatttgccgtcaagtttggtttggcagacggcggttcctgtggtagaatgggcaggtagtttagggcgaaaagcgccccctgccggaccccggcgggcagttttcggtttgaggtgatggggatgctgcggatcggcatctgtgacgatatctacgacgccaggctggtgcttcgggccgctctggagcgggtcctggaaaagcggcgcgttcaagggcagttccgggagttctcctctggcgagggactgctccgctggctggagagccacgccggggagctggacctggtgtttctggacatggagatgggggagctggacggcatggagaccgcccggcggctccgggcggcggacgccggactgcagctggtgttcgtcaccgggtatgcagagcacgtctttgacgggtactccgtgggggccctggggtatctcttaaagcccccgaaggcggaacagctggaggaggtgctggaccgggcacaggcggcgctggtccgggatttggaccgggcctacatctgccgcagcggggacacccactaccggatccccattgccaacattctgtatttcgtctcggaccggcggcaggtggcctgtgtcaccgccggacgggagtacacgttttacggcaagctggacacggtggcggcggaggtgggggcggactttgtccgcatccaccagcggtatctggttcggacaggagctgtggaccggatggagggcggcgaggtggtgctgcgggacggccggcggctgccggtcagccggtcctgccagccctcggccctgctggcctttacccgggcggagctggagggatgaggatgcgggatgttctctggcagatctggctcaactgcggctattttctgaccgtggcggccagcggctttttcctctacaagctctgtgccccctttgtccgcccccggaatgggcgcttctggagggtgctgctctttctgaccctggcggggtccaccggcatggtgatttggatcggcgaccccaacctgctctatacgctgccggcgtttttcgccttgttcctcctctctacccggggtgaccggatagggcgggtggcggtgtgcatcatcctcttctgcctggagatgtccgtgtgtgccctgctggacacctatgtggagcggatcaacaggaatgcgctctatgacgtgctggtgcgcctggcccgcccgctggtgttcggcccgctgtggctgttgctgcgccgccgcctgccccgggagccggtggtgctctcccggcggctgtggaagctggtgctgggtctagcggccatgcccctgtgcgccctgattgccgtggtgctgctgaccttccggcggtatgactctatcgaggtcaataccgtggcgatgtaccagggcatggtggtgctgccctttgtatttctgacctctctggtcctgttgttcgccattttgattctggcggatcacgagcggctggagcaggcaaatcgcctggcaggtctgcgggaggtctactatcagggcctccggcagcaggagacccaggtgcgccgtctccgccacgatctgcggaatcacctgacggcggtccggggttttctggagcagggagatgaacagggggccatcggctatctggaccagatagccggttccccggccctgcggggaaccagacggctctgtgaaaacgaggcggccaatgccgtcctcaccgccaaggcggaggccatggagcgggagggagtcgccgcagacttcgccgtcttcctgccccgggacctgcctgtggcggatatggatctgtgcgccctgctgggcaacgctctggacaacgccatcgagggcagccggggcgccggggaacggcgaatcaccatccgctgcaaggcggacaagggactcttcatgctgcgggtggagaacaccctgggcggcgcggtgcagccggatcttgcaactaccaagacggacaaggccgcccacggcttcggcatccccgggatgcgggaaatcgcggagcgctatggcggcaccctggacgccggggtccgggacaacgggttcgagctggtggtgtgcctgcccctggcagggcaggccgaaacactgtaaatccccatgcgctgacggccgccgcagacacaggagagagctcgattttccatatctgcggtgtatttgcacagaaaaacagggagaccgtccaatggacggtctccctgctccgcagccaaagcggactcaaagcatcttcaaaagttcgatctgttccccggaggggccagtgaagaaccagttctccaacccgccgaaggtgttgggcatcacgcacttctctgcggtctggaaggtgtccacgccggcggcgcggagatccgcggcggcttggtccacatcgtccacatagacggcgaaatgagggatgcagcccgcaccctccggcacaggggcggcgatcaactccaccaggaagccgccgaactccacaagggccagctcccgctgctgttccggcgagcaggcgggggcccggagatgcaggctgccgccgatcttctcgtaaaaggcgatgctggcatccatatccgccgtatacacggcaatgtggccgagaccttgatagtgctgtttcatacaatcagtcctccagtatgtgaaaaatgaaaatatggcatcaggaggcggcagtccggccgccggggatcagggcgcccactgcgccgcagacagcggcgggcaacacccagccgaaatccagagacgccaggggcagcaggtccagaaaggccagctccacgccggtgtaggtgcggactacctccagcaggctcactgccagggcgcccagggccgccaggcggaacacccagtcccggcggatgcggctgccgaacagggccagcacgatcagcaccagcgtggggggatagaccacgctgaggatgggggaggcgatggcgatgatctcattgagaccaaagttggataccacggcactgaacacgcagatgacgcacaccagcgtgcggtaggaaacgcggccccccgagaggccggagaagtaatcggcgcatgcgctgaccagccccacagcggtggtgacgcaggccagagccaccaccacggcaaagaggatgatgcccgcctgccccagcaggttccggacaatggacaccaccaggaacgtgcggtccacggtgatgtcgaagaagcgggcggtggtggcgcccagataagtcagccccagatagaccgccagcaggccgatgcctgccaccagactggcgccggacaccacccggagctgggcgccgggagtcgtgtgtcccttctcccgggcgctcttcagaatgatatagccgaacacgatggccgccagcacgtccatggtctgatagccggcttccacgccggtggcggccacattctccaccagcggctgctcacccaccggcccgatgggattcaccacacccaccacgatcaggatcaacaggccaatcagcagagcgggggtcaggatctttcccacgatgtccaccaccgctgtttcccgcacgcacagcagcaggatcagcagaaagaagaggatggagaagagcgccggactgaagccggacaccagcggggccagagaggtttcgtaggtggtggcggcagtccggggaatggccagcatgggaccgatgcacagcacaatggcgcacatgagcgctgtggagggaatcctgccgatgcgggcggtgatcccgtcgggacttccctgccggagaatggcaaacatagccagcagggccagtccgatgtcggccataaagtaactgaaaaagccggccagccactccggacccgattccagtcccagataaggggggaagatgacattacctgcgccgaaaaacatggagaacagggcgaaaccgatgaccaagctgtcctgaaggtgtttcttcataggagacctcctcttgccttgcaggtggacggatgtccgctgaataagggcaaagcggccgcgcggacgacgcgcggcctgtgtatttatttgatgtttatgcttgaaacaattatatttgaatttccgaaaaaagtcaatgttatacacaccgaggcggtcatgggcggagcagcggagaaaaatcgccggagcgggaacttttttccgtagagcccgtctaacctctcagaccgcggcggagcgccgtgaaatcccgtgagaggttaggagaaaaacatgaaaaagagaggacttgcaggattgctggctctggcgctgatactggcgctgggtgcctgtggaggaacggaggcgcaggaggacgccgcccaggaccagaagatggaggaagctgcgccgccccaggaggaagagacttcggaaaccgatggggaggacggcgtccctgtgaccatagagggccctgagacggcggatgattcccagcagctccaggaggacgagccggatctgggctcccgccccgcggacccggcgaaggagccggagacggggagccgtccggcagacccggcggagaagccgatataccagccggtggaggacacaaagccccagcagccggacaaggagccggagacgccggcccagcccgcccctgcccctccagcggagtctgcttccggcgtggatctagcggatttctgcgcttccgtgaccggggaccaggagacgtggcccgccctgatggccgtggagggtgagacgctggatacgttctatgcgggactctccgccatcgccacccagcagtgtctggtgcagatggccatgatctccgcctccggtgacgagattgccctggtagaggtggagaacagcggcgatgtccaggcggtgaaggacatcttccaggcccgaatcgactatcaggtgggggacggcacaagccccggcggtgcctggtaccccgcgcccacggagatgtggcggaacgagtcccggattgtctccaatggcaactttgtgatgctggtggcgcacaccggcgcggacgcggtggtggagcagttcaacgccctgttcgcctgagtggggtcccgcaatgcggaaaacgaagcaggactttttaagtcctgcttcgtttcgttccgatcagattttgatgagctcgtatgcccgggtgccgatgccgatcttctccgcgtgctccaggcagacggcccagtccgtgtccggatgggcggcgtggaagtagtcaccggaggagcagtcgcagccctcgtcaaacagggcggagttgggcgcgggagtctgggccagcacggcgtcggcacaggcttggtccagagccaccgggtcgaaggaggcaaacatgcccacgtccgggacgatggggacatcgttctccgcgtggcagtcgcagttgggggagacatccaccaccagggacacgtggaagcaggggcggccgtctaccacggccttggtgtactcggcgatcttcttattcagaatagcgggcgcctcgtcatacaggcactggatggcatccttggggcacaccgccagacaccgggcgcagcccacgcacttgtccgtgtcgatggtggctttgccgtcggcaccgaactggggcgcgccgtgggcgcagatcctggcgcaggcccggcagccgatgcacttcttctgcttgacgaagggcttgccggagttgtgctgctccatcttgccggcccgggagccgcagcccatgccgatgttcttcagagcgccgcccatgccggcctgctcgtggcccttgaagtgggtcagggagatgaacacgtccgcgtccatcaccgcacggccgatcttggcggacttcacatactccccgccctccacgggaacctccacctcgtcgttgcccttcaggccgtcggcgatcaggatgtggcagccggtggagtagggggtgaagccgttgatataagccgattcgatgtggtccagggcgtttttccggccgcccacatacagggtattgcagtccgtcaagaagggcttgccgccgtgggacttcaccaggtccaccacggcccgggcccagttggggcggaggtaggccaggttgcccggctcgccgaagtgcatcttgatggccacgtacttgccgtccatatcgatatcgccgaagccggcggtcatcatcagccgggccagcttctggggcaggttctcccgccagctgggggcgcggaagtccgcaaagtagactttggatttttcagccatgatctcgttgctcctttttctctttctgttctttgaaacaagcctggagagaaacctctccggtgccggggcggcgtgccttccgccttacggcaggtccacagagatgttgtcggtgccgtgctcgtcaaactcggagagataagcgtcgatccgctccatcagctccccatagttttcacgggtcaggggttccccatccatgtcccgcagggccagctcctccgccaggatctcatagaacaccacgtcctcatactgctcgatggcctcgtggatgccgccgtccgcaaaggcccgggaggggatcagctccccccggtacagctccaccagcttgctcatcttgtggtgcaggcagtgggagaaaatcaggctctccacctggtcgtattcctggatgcggtcgttctcccgggtggaattgatgacccagtttcctatgtataccagatccagcagataccggaactgctgttccgtcagttcgatcttcatggggcagacacctcccaaatagatgatactgtcacgattatagcagagacatacgcagaattccacataaaaaacagggcaaaaagactaaaatctgtcttgcggcagaaggcgccgcatagtataatatgtaatccagatgcaaaatgagcatgaagcggccgccggtccggcggcgggagaagaaggaggcggagcgggatggaccagcgtcccatcggggtattcgattcaggcctggggggtctgacggcggtgcactccctctggcgcatcctgccggaggaggacctgatctacttcggcgacaccgcccgggtgccctatggcagccgttcccgggaggccattttgaaatacgcccgccaggatgtgcgtttcctgcgctccttcgatctgaaggccatcctcatcgcctgcgggacggtgaccaccacctcgctggcggcgctgcaggcggaaaacgacctgcccatggtaggcgtggtagagcccacttgccgccgggcggtgctgatgacccaaaacaagcgggtagggctcattgccacggcggcctccgtccgctccggtgcctacgaggcggctctccggcggctggacccggaggtgaccgtgttcagccgggcctgccccctgttcgtgcccctggcggaggccgggcgcatccggcggggagacgtggtgatcgagaccgtggcccgggagtatctgacgcccctgaagaatgcgggggtggacaccctgattctgggctgtacccattacccgctgctgacggatgtgatcggggacgtgatggggccgggcgtggagctggtgtccgccggggaggagtccgcctttgagctgaaacggatgctgaaggcccgggagctgcgggcggacgagcgccgccgcggcgagacggagttctacgtcagtgaccgggtggaggattttgagcggacggcctcgctgtttctgcaggaggacctgcgccatacagcacggaggattgacattgagcgatattgagacgcggcagaagaagctgccggtgctgctcttcatccggggagagcagtattttgacgatgtggacccggatgccacggagctgacgacggaggggaccctggagctgacggaggagggcctgctgctgacctatcaggagacagccctcaccggcatggaggggacgaccaccacctttgaggtcagcgggccccaggtgatcctgcgccgggtgggcagtgtgaactcccagatggtgtttgaggaggggcggcagcacacgtccctgtatgagaccccctacggggagctgtcggtggatatccagaccagcgccctgcggcacaacctcagcgagcggggcggcctgctggagatcaagtactccatcgcggtcgagcatacggtgacaggaagaaacagcttcaagatccgggtaaagcgaaagtaagagagcgttccggcaaaccgtgcggcagcgcgtccaagtattttggaggagccaaaatctttggcggagggcgaattcatttcgcccggggattccgagaaaaggggtccccgggatctgtcccgtgggaagcgcacggtgacagggaaaaacagctttaagacccgggtaaaacgggaaaaacaggggttgggaattaggaattgcggtgccgccgcaggtggcaattggaatctgtccggctttgccggacaccaaaattcctcattctgaattcctcattcacgaaagagggaacgatatgatcaacatggtacaaaacgcgaaggaccaggcggcggcgctggccatggccgcctatcaggcggcagtggcggacgggacgctgccccaggcggaggtgaagaccgccccggtggagatccccaaggacaccgccaacggcgacttcaccaccacgtttgccctggcggcctccaaggcgctgcggcagccgccccgtaatatcgcccaggcactgctggaccacatggacctggcggggagctactttgcctccgcggagattgcgggaccgggctttctgaacttccgtctcaacgacagctggtacgctgccgtctgcgaggcggtggagagcgagggtgccggctacggcaccgccgaccacctgaaggggcagaagatcatggtggaattcgtctccgccaaccccacgggccccatgcacatgggcaatgcccggggcggcgtgctgggagacaccctggccagcgtgctggcggcgtgcggcgccgacgtgacgagggagttttacgtgaacgacgcgggccaccagatcgataagttcgcccactccattgaagcccggtatctccagatcatccgggggaggacgcggtgcccttcccggaggacggataccagggtgaggacatcaaggacctggcccgggcctattatgagaaaaacggagataagctgttggatgtgccggaggcggagcgccaggaggcgctggcccagttcgggttgtccatcaacctgcctaagatgaagaccgatctggagcggtacaagatccactatgacaactggttctacgagtcctctctccatgagagcggctatgtgaaggagacagtggatctgctggcggagcggggctggacctatgagaaggacggcgccctgtggctccgcacggccgacatcctacgggaccactaccgcaggcaggggaagaaagaggcggacatcgagaagctggacctgaaggatgacgtactgcgccgggccaacgggttttacacctacttcgccgcggacatcgcctatcaccggaacaagttcgctgtccggggcttcgacaaggtcatcaacatctggggggcggaccaccacggccacgtggcccggctgaagggcgccctggacgcgctcggcctcaacggcagcgagcggctggacatcgtgctgatgcagctggtgaagctgctgcgggacggcgaggtggtgcggatgagcaagcgcaccggcaaggccatctccctctcggatctgctggacgaggtcagcgtggacgcagcccggtggtacttcaacgccaagccggacacccagatggagttcgacctgggcctggcggtccgggaggacagcgaaaaccccatctactacgtggaatacgcccacgcccggatctgctcgctgctgcgggctctggcggaggagggcgtctccgtgcccagacaggcggacgtggacatgtccctgctctccggtgaggcggaacgggccctgctgaagcagatcgcccagttctgcgaggagatcaagctggcggcccgggactacgaccccagccacatcaaccgctatctccaggagctggcagcctgcttccaccggttctacaccgcctgccgcatcaagggcgaggagccggcggtccgggacgcccggctgaagctggcggacgacacccggatcgtcctgcggaacggcttgaagctcatcggcgtggacgcgccggagaagatgtgacgagacggcgcgcggcgcaggagggagacctatggaatttcagagagagccgggacgcatctacgccatggaggatgggcgcctgatcgccgaggtgatgttccccgaccgggacggagtggcggagatcgaccacacctttgtggatgacaccctgcggggccagggcgtggcaggacagctgctccgggcggcggccgaccaaatccgcacggaaggaaagcgcgccagggcgacctgttcctatgccaagatctggtttgaaaagcacccggaggaggccgatctgctgtgcccctgagagacgacgagagccgccgtgccggcgggagcagcatggccctccgggcggcgtttcccgccaccatcccggtgatgacgggctttctgtgcctggggactgcctatggccttttgatgcagtccaaggggtatgggccgggatggtccgtcctcatgagcgccatcgcctttgggggcagcatgcagtttgtggccgtcacgctgctgaccacggcctttgaccctgtgcaggcgtttctgctgtccgtcatggtcaatgcccggcacatgttctacgggctgagcctgctggacaagtacaagggcctggggaaggtgcggccgtttctgatctacgtgctgtgcgatgagacgttttccctggtgtccactctggagccgccggagggcgtggcccggaaggacttctacttctggatctccctgctggactacctctactggattacgggcacagccctgggcggcctgctggggagtttcctcacctttgacaccacgggcctggactttgctctgacggcgctgtttgtggtgctgttcctggagcagtggaagaagccggagaaccggcccgccggggtgatggggatcctctgcgccgccgccagcctggcggtgttcggagcggacaacatggtgatccccgccatggtgctggtgctggcggtgctgctgagtgcacggcgccgcctggaccgcagcggagaggagggagccctgtgacgctgacgcctttgcagacgctgggcatcatcctggcggtggccgccgggacccagctgacccgatggctgcccttttggttgtttccggagaagaaacggcctcccgccgtggtgacatacctggggaaagtccttccgcccgccatgatgggcctgctggtggtgtactgcctgcggagcgtctcctggctgtcggcgccccacggggcgccggagctgatcgccattgcggcggtggcggggctccacctctggaagcggaatgtgctgctgtccatcgccgggggcactgtgctgtacatggtgctggtacaggcggtgtttgtctgagaaaagagaagagatgccggccggcggaagcccggccggcatttttcagtgccgggggaggcttccttgtttccgaatcgttacaatttgttgtgaaactgagtggatttttgcaaaaaatcagggtattctgggcatgaaatgcagagaacggagcgcaaaaaccaggacctggaaagcgaggtgcgaacatgaagcgatttcttctctgcggggtgctgctggcgctgctggccggctgcggcactgccggggagcagctgccggaggaagtcccggaagagacggagcccctctccggcgaggagctgacggcctccgccatggcggcgtacgctgagatcacgaaggacctgactttcaccctggatgtggaagaggaagatgccacaggcatcagcctctccatcaccccggaggccgcccggaacgtggcggggcgggagaacctgttctccatcggctaccagtgggagccggcctcggcggaggcctggggagaccagtggagcgacatcaaaagcagaggacggctctttgccatgaccgccccggacggggagaccaccctccagtgctgcaccggcggggacgtggtgctgtggaccgtggacggggagacccactatgcctgtgtgacggctgcggcggagggggaatccggcctgagcggtctgctgcaggggatcgccgaggacgccctgtgggacgcggcgttttgcggtcccacggtggatggggcagagacggactacgaagagatcgcccggcagctgaacgaggccgtggcggagaatgtccgccatgtgccggactgggtcagctggaagcccctggacttccaggccaacggcgccagcgtgtttgacgcctattacggtgagccggagaacttctgtgccgggctgggcttccggctgctggtggatgacccgtatggagagatggccaacagctggcaggcgggcgcagggctgggagaaccggatgcggacgggtactacggctatggcggcgaggccagtatccagaaaaatgaggacggcgactggacctgcgacggtctggccaccggaggcagcgccgtgacgctgccactgtccggctctggggaggaagccccgctttcggagctggtggacgcattctttctgacggaggggttctcccatgactggctgctgcccaactacatcctggaccacccggcagaggacatgacggccctgcccgccctgctggatgaccggacagacgcagaggcccgggagctgtgtgccgtcctgggccggtgcctgcgggacgccgactactgggactgggcgccggagacgctggcggagactctgggaagctatggggcgtatctggatgcataaatctgccaacgccggtataaactgggactgcggcctggccgcagtccttttgttttgtcatggaggcggatatggggaagcggttgttttactgggagctggcgggtgcgctgttcacggcggcgctggggacgctgctgcactttgcctacgactggagcggcggatggggcgcggcggctgccttctccgcggtgaatgagtccacctgggaacatatgaagctgctgtttttccccatgttcctgttttccgtggtacaggtgtgctgcctgggacgaaactatccgaactttctggcggcccggggcgtcagcacggtgacaggggtcgcgctgatcccggtgctgttctatacgtacaccggcgtgctggggcggcatctgctctgggcggacatcgccgtgttctacctctccgtgctgggggcattcgccctggatttccggcttctgcggcgggggcggttcacctctctctggcagcagatcctgggcctgctggcgctgtgggggctggcgttccttttcgtctactgcacgttccatccgccggagctggggctatggcaggacccggtgacgctgggctatgggctccccaaatgaaagcaggcgcccctctttcgagaggggcgccgctttgcttccggggattttctgtccctgccgttgaccggctctctccggcggggtataatattgttaaaagcgacctggggaggctgaagcggatgaagaccacaagacagaagcgtgcggcgcctttttacgccgctgcggcggtatggctggcctacgcgctggtgctgccgctgtatgagccgctgcactatgccctggcggcgggggcctcccttctggcgttcgcggcggcggccgccctgtgccggggcggccccgtaggagaggaggctggcaaggcgccgccggaaaaggccgaggagcccgttgaaaagaaaccggcctctacaggaaatcctgagctggacaagatggtccgcgacggggagatggccatccgggagatgaaacggctggatgagaatatcgcggaccccggcatctccgccgacattgtgcggctggagcaggtgagcgcccgaatcttcgacgaggtgcgcacgcacccggagaagctgccccagatcaggcgctttctggactactacctgcccaccaccctgaagctgctgaatgcctatgaccgcatgagcggtaccggggtctccggagagaacatcgacaccaccctggccaaggtggaggggatgatgcggaccatcgtggcggcctttgaaaagcagctggacagcctgtacggcgccgaggccctggacatctccacggatatcacggtgctggagaacatgatggcccgggagggactggtggacagcccgctgaaggcggagccggacgagaagaaagagaccgatatccggctggagctgtgatcggaggaaacgccatgagaaagatcgccatcagaatggcgggcctggttttctatatggccgcaggatttgtccttctgttctggaaactggagcgtggcgggttgcataacgcggagctcctgctgccgctggcatggctggcgggggcggtggctttgggccttcggctggacaaggcctgtaaacaggcgggaaggtggggagaggctgcccatcactttttctcttccgtgatatggctgctgcttggtatcggttttatgaagcaggccccgggcatctgtaccctctgcggtgtgctgggggtggtgtacgcagtggtttatgctgtctgcggtgtgcgggcggcgggagaagcccgccggaatgaagaaaatggcagagagtgaatgatactatgatggaggatgacacaatggcagacgagaagagcatgatgcctgaactgaccctggatcccagccggacggatgcggtgccccaactgactctggacccggcagcgcccgccgcccccgcaccggaggccgccaagccggaggcgacgccggtgcggctggacgagaacctgctgaacgacgcggagaaacaggcggtggaggcgttttccaagaagatcgacctgacggactccaacctgatcctgcagtacggcgcggcggcccagaagaacgtggccagcttttctgagaacgccctgaactctgtgcgcaccaaggacctgggagaggtgggcaagtccctcagcgagctggtggtggagttgaagggcttcggcgaggaagaggagaagaaggggctcttcggcctcttcaaaaagacgggtagcaagctggaggccatgaaggcccagtacgccaaggtggagtccaacgtggacaagatcgcccgggagctggagcagcatcaggtcacgcttttgaaggatgtggccatgttcgaccagatgtatgagctgaacctgaaatactacaaggagctcaccatgtacattctggcgggcaagaagaagctggaggacatgcgggcgggcgaactgcctgctctgaaggccaaggcagaacagtccggcgctcaggaggacgcccaggcatacaacgacatggtccagatgtgtgagcggtttgagaaaaagctccacgacctggagctgacccggatgatctctgtgcagatgggcccccagactcggctgctgcagaacaacgataccttgatggtggaaaagatccagtcctccctggtgaacaccatccccctgtggaagagtcagatggtgctggccctggggctggagcacggccgccaggccacggcggcccagagcgccgtgacggagatgaccaatgagctgctgaaaaagaacgcggatctgttgaagatgggcaccattgagaccgccaaggaggcagagcggagcgtggtggacattgagacgctgcagcacaccaaccagcagctgatctccacgctggacgaggtgctgaacatccagcgggagggcgcccagaagcgcagggccgccgaggcggagttgggccgcatcgagggcgagctgaagcaaaagctgttggagctgagaaattaaagggagagcaggatccccctttggaatccccaccagtctgcggactggtgaacgcgcccggggcgcttggatcaaggtagtttcgccacgtacacgctgcggcgaaaatgattcaaatttcttctttcgccaatggcggaagaactggggaaaaccggaggctttcccttagccccctttcccgcttacagggaagggacggagaggacatacgcttatgaagttttttcagaaacgggccgtggcggcggtggtgctgattttagccatcgtggccggggtggtgattgggcaggccaagaagccggacaccggaggccaggcgtccaccgccattgtggggtcctatacgtatgtatatgactacgccggggtgctgacggatgagaccatggagcatatcgacgccatgaacgcctccttgtttgcccagaccggggcccagatcctggtaagtgtggtgaactccactggcggcgcggacatcatggactatgcctcggatctggggaacagctatggcgtaggctccgcagagcggaacaacggcgtggtgatgctgctggcgctggacaacatctcccaaagcggcctgatgggcgactactgcgtggtggtggggaccgggctggagagccacgcggacgatttcatgagtctgcagtcctattacctggagaatgatttcgctgccggggagtacgacgccggtgtgaaggcgacttttgatgccttcatcgcctggtttgccgacttctacggcgtcacgatccgggaggggtatatccctgccgtccgggagacctattccagcggcagcgggtactactatacggagacccacggctatgtggcgccggcctttgggtccctggtgagcggcgttgtggtgctgctagtggtgctgctggtgctgtgggtgatcctggacggaatgcggtactcccgctaccgccggcggtatctgcggcccggtatgggacggcccacggtgctgtactaccccatcttctggggacggccccagcggcccaggccaccccgtcctccaagaccgccaaagccaccgcgccggccgccctccggcggaacattcggcgggggcggcttcggcggcagccggggaggcatgttcggcggaggctccttcgggagtgccggagggtcccggggcagcctcggcggagggaccttccggggcagcggcggccgtcgcggcggctttggcggaggctccttccgcagcggcgggcgccggtaagagacagatataacggggcctgtatgccatttgaaaagcaggaggatcccccggagttccgggacgatcctcctgcttttgcgttggaagaagtattacttttgcggtgcggctcagcggatggggagcattttgccggtctcaaaggattccttgcagcgataggccgcctcggatacagcggtgccgtcgtagaccgtcaggtccgcagggtgtgtgccggtacggatgtggtccgtaaacgcctgcatctcagccagaaaagcggtgtgccagcgggacatgaagtccggatagtactcctgccgcgcaccatgctcatccacgacctgcagcaggttccgggcgcccacgggggcgatgcgcagcgtgccgtgggttccgacgatttccgtctctacattgcagcctgctgcatgggtgcggttggcaaagagaaagcccatggcgccgttttcgcactggaccatggcggcggcattgtctgtgtcatgcagttcccgacagaggtcgaactcaaagacaccaccgatggcccagacgttacggatgttagagccggtgaaccagcggatcagatccagatcgtggacgcacatgtccaggaactggccgccagagtgggggaggaatttcagtgtggattcaatggtgctgcggggatcctgggtgcaggagcggaccagcaccactttgccgatttcaccggcgtccacacggcgcttggcctcagcataggaggggtcaaaccggcgcatgaagcccagttggaacaccagttccggatgggcctcaacaaccttttcagcttccttgcactgagccacattggtgcccagaggcttttcacagaaaacgtgcttgccgtgctccatggcaattttgatctgctccacatgaagaaaagagggggagacgatgacgatgccgtccaactccggatcggcgcacatggcggcaaaatcggtgtaagtatgaggaacgcccaattcctctgccaccgcccggagacgggaggtatccacgttacagatggcgtggaggacgcagccgggaatggatgcggctaagttttttgcatgttcgtagcccagacggcccaggccgacagagccgattttaacagattccatatagcaccttctctctgggttttcaattttacagtatagtctaatcccccaaaaatacaagcgggacctgccttgaaagctggatactgccaaagaacttgaacagcggcacggctcttgagagccgtgccgctgttttgcgggaaagtggtccctggggatcagtccacctcccgcagccgttccacgatggtggccttggagacggagcggtacaccgccaggggaaccaggacgcccagcagggcgaacaccggggccacgatcaggaacggggtcagcgtcaggcggtaggtgaagaaccagaacatgctccccaccgccttgaaggccaccgggccgaaaatcagggtcagcaccagggagatcccagccgcccccagggcatagagcagcccctcatacaccagcatggtcttgagctgcttgccggccatgccgatggactggagcacggcgaactcccgcttgcgggcgatgatgccggtgaggatggcgttgaagaagttcagcacgcccaccagccccacgatgaaactgagggccccgccgcacagctggaacatggagcgcatcccctcgaactccgatgcgtagagcgccttgctctcatagtcgaactggggattcacgttctctgtgtagtctgccaggaacttctccatggcgccgttggcctcgtcggtggtatcaaaggcgtagtacatcacgctgtctgtgccgctgtcctgcatgaaggtctggtcattcaggatgaactcgtccgcgccgtagtagcggtagctgagagagatgggcacggcaaccagggcggctacttcgtattccacatcccggtatttcaccggctgcgccacatagttggcactggcgggcacgtcctccgggctggcgtaggcgatgccggtgtccggatctacatactccgtctcctccacgtaccggacggtgacgatgtcccccagccgggcccagtgggagtccatctccggattgccgtaatcatcatcactgtacacagcggccacataccgcccgccgtcctcatagagcttggacaggtctccctccagtaccgtcaggtggtccaatgcgaaatcgctcatgccggagagctggatccggtcggccagcaggccctcttcgttccgcccggtcaggcggatcagattgtccatctgctcctgggtatagaagtgctccttgttctgccggaaccagtcctcggtaacgtactccagggcatcgaacgtcttgccgtagatcacgccgccgtcggtaatgccgccctgggcattgatctcgtcaatgacggactgggggatgcccatatccgtgttgaagatgtccccgccggtctggaactggccggcgtccgccacgatgaagtcgctggatgcgaaatgagacacgtacttgtccatgtcgaagccgttggtgaagttcaccgtcactgtcagcagtaccaccgccagagacagggacgtgacggtgacggcggtcttgccccggctgcggcccaggttggcccaggccatggacagcagggacacgcccctgcggccttttttcgtcttgcgcttgatgccgccgccttcggtgtagcgcactgcctcgatgggagagaccttgccggcgatgcggccgggcttccggcaggagagcagcaccgtcaccagagagaacagcgccgcgccgatgaagatcaccgggctcacggaggtcatgggcaccacgccgttcagctgtgacacaatggccggcgtcagctggccgccgatcaaccaacccagcaccagccccagggggatgcccgccagggacaacgtcagcgcctgctggcggatgatccgccgcagctgccggggcgtggtgccgatggtcttcagcaggccatagaaccggatatcgttggtgacggagatctggaacacgttgtagatgatgagatagccggtgaagatgatgagcagcagcatggcggccacagcaatcaccacagaggggtccagattgtcgctgagctgggcgccggtatagccccagttgacgccagtgtggatataatccggcgctccggcgctctgatcctgatagccgtgattttccagaatttgagcgatatcgttcgcaatgtggcgggaaccgcttttcagcatcacatccaggttccaggaaccggtcatgccatcctctccgggcgggacggttcccacctcgtccagaatggcgtccgcccggctcttcggaatcaggatgtggttggccacaattgcctcgtcatactcccaccagccgcagagggtaaaggtctgggtggtggtatggccgtccacgtcaaaggagatggtgaacctggcgccgatctccggctccacccccaacagctccagcacgtgggtgtcggtagcggcctcgtcggtgccctcctggggcagacggccctccaccgggtcgcagtacatccagtgggcttcattggcgtcggcgtagctgacctccacgtgggatttgttgaacggcacctccgtgggcattccgataaaccgccgcattccccactggtcgatgagggggtcatccttcagatcgttaaactgttcctccgtcaggtacttgaagccgccgtgggagaagccgcccacctgacggaagttggactgctggaacccgtcgttgatggacatggcgatggtgaagagggacgtgaacagcaccgtggtcagggcgatggcgagaacggcgatgaggttgcgggtcctggccgccttcatggaccgccagcccagacggcggatggtcttgccgttggataccttcatcatggcgctcacccccgcaccacgatccgcccgtcctcgatgcggatgatccggtccgccatctgggccagctcctcgttgtgggtgatcatgacgatggtctggctgaacttctgggcagtgaccttcaggagtcccatcacgtccaggctggtggcggagtccaggttgccggtgggctcatccgccaggatgatggcgggcttggccgccagagcccgggcgatggccacccgctgctgctggccgccggagaggttgttgggcaggttttggagctttgcctccagccccagcgtctcaatgatccgttccacataggctttgtccggcgcgttgccgtccagctggatgggcaggacgatgttctcatacacgttcagcaccggcaccaggttgtagttctggaacacaaagccgatcttccgccgccggaagatggtcagttcctcatcgcgcatggcagagagttctttgccgtccaccgtgacggtgccgccggtggggcggtccagcccgcccagcatgtggagcagggtggacttgccggagccggaggtgcccaccaccgccacgaattcgcccttttccacggtcagatcgaccccgtccagggcccggacctccgtatcgccggagccatataccttccgcagatcctttgtttccaagatcgtcattgttcattcctccaaggaaaagtctgtattgccagaaggcaatacagacttcggctatctccataaacccggagggcttatttgacgggaaggaagatagctacgaaagactgcgcccgcaggcgcgattcagagcgcaaccgccgcaaagcggcggcacttagcgcggagataacccaggaggggtgtctttcgttttcaatcaatcgttttgagaactttaaaagttctaaaaacgcaagcagcttggcgaaaagactttttcgacaagctgagtctgtattgcctttcgacaatacagactgtaccaaagaaatctttccacattctttctgaaatctaacagttctgaaagatttgggatgtccgggccggaacgcgccgccttctacgtcctctcctccgccctcggcaggaacagggagaaggtgctcccctccccggggcggctgctgaccttcaggtatccgccctgaccggcggcgatctggcgggccagatacaagccgattcccacgccctccgcctcgctggcggagggggagcggtagaaccgctggaagatcctggcctgctcggactccgggatgccggggccggtgtccgtcacgtccacgcggcagaacagctcataccccacggcccggagggtgacggcgccgcctgccggggtgtatttcaccgcgttgtccaccagattatacagggcctccgctgtccacttggggtcgaaccgggcggtcaggtccgtgggctctaccgtcagggtgatcgctttggcctccgctccgggagcggcctgggccgaggcggcatccaacagctgttggatgccatgacgcttgggcgtcatggcaaggacgccgctctccagccgggaggttttgaccagcgcgtcgatgaggaaccgcagcttctccgcctgatgctccagagcggaggcatactcccggctctccggcggcaggtcctgctcctccagcagctgggcatacagcaggaggttggcgatgggagtcttggtctggtgggagatgtccccgatcagggtcttgatggcgtccttctcctccgccagatttttggccgatacggcggatgcggagagatagtgggccatccgggtctccagggcggagaggcggctctcgtcatagagggactcccggaactcgccccggatggcgtcatccagcatcttgcccagagtgtccagcatccggcgggtccgcaggcgggtccagacggcgaatcctgccgctgccagcagggccggaaccgccagggccagcagggtgtattccactgtcatgtcagttcaccgcccatgtgtagcccaggccgtacacggtcttgatatagcggggcttggacggcatgtcttccagcttgtcccgcagccgcttcactgtgacggagagggcgttttcgtccacatactccgccccgtccgtccagatccggtccaccagggcggcccgggtaagggtttggccccggtgctccaccagcagccgcagcagcttctgttccgtcttgctgagctccaccggaacgccgttccgggagaactccatccggccgaaatcgaaggtgaagccgtccagctgcacccgttccgcctggggggcggcggtccggcgcagctgagtattcaccctggcccgcagcaccgccagagagaagggcttggtgatatagtcatccgcccccagctccagacctgccacgatgtctgtctccaggtcattggcagtcaacaggattacgggaacctcactctcccgccggagggcacggaggaggtccagtccattgccgtcaggcaggttgatgtccaggatcagcaggtcgaagctccggcgggagagcagctccccggcatccgccagggaccggcagagctgggggcggagctccggcgcctggagggccaggcggataccctcgcccagagtcgggtcatcctccacgatcagcaggtctttcatcggggaacctccttgggatcaaactgcgcccagtataccacgggcggccgccgccgtccagagcgggcagaagaaacgcacggcggacaggccgccgtgcgtgggtcgcgggatcgcgggtcacagggtcagggagggggcggcataggtccgggccgccagctcctggtccagcatatagagccccttggggtccgagccgaacagctccatcttcttgatgagatcggtggcgttggtctcctcctcaccctgctccttcacgaaccagtccaaaaactgcatggtgcggaaatccctggcctcgtacgcggcttcatagatggcgtggatcagggaggtgacatactgctcgtgggcgagaccggccttcagggggtccatgttggctttcagctccgcatccggtttggcgacggcctccagcgttacgggcacgtcgttgttctggagatactggagcatcagcatggcgtggtcccgctcctcctgggcctggaccttgtaccagttggcaaaaccggcaaggccctgctccacatagaaattggagaactggagatacagatacgcagagtagaattccttgttcacctgatcgttcaacagctgggatactttttcgttcagcattgtatgcgcttcctttctgcagcggacgaaatgtccttgtttgttctatctaaccattatatcacggactgcagaaaatgcaacggcagccgggaaaaaagcggtggacgggcgggaggcgctgtgctacaatgggcgtgctgcaaagtccctttttgggaaaactttaacgggaaccaaacggcaggggccgcctttttacagaccggcgggcccatccgtgttatcatggtcctgctgtccacgggcggcttctgataaaacggaaagagggatcgctgtgttcatgcgcagaaaaaaccacatggcgccggcgcggatcatcctgatcggctttgcgctgctgattttggcgggagcactactgctgaccctgcccatctccacccgggacgggcagggcgccgcctttttcgacgcgctgttcaccgccacctccgccacctgcgtgacaggactggtggtccaggacacggcgctgtactggtccggcttcggccaggcggtgatcctcatgctgattcagattggcggcatgggtgtggtgaccgcggcggcggccatctccatgctggccgggcggcggatcgggctgaaggagcggtgggtgatgcaggagtccatctccgcaccccaggtggggggcatcgttcgccggacccgcttcattctggcggtgacgctggtcctggaggggacggggacgttgctgctggctctgcggttctgcccggagatggggctgttccggggactctggtacgcggtgtttcatgcggtgtcctccttctgcaacgccgggttcgacctgatgggggcggcgggcacgcccttcgtctccctgaccggctatgcggggacccactggtgaatttcaccgtgatggggctgattgtcctgggcggcatcggattcctcacctggggagacgtgcgggagcacaagtggcacctgcgggcctactgccttcagagcaagctggtgctggcggtgactgcggcactgatcctgctgccggcgctgttcttcctgctctatgagctccggctgccccagtggcagacgctgaccctgggggagaaggtccagggggcgctgtttcaggcggtcaccccccggaccgcagggtacaacaccctggacctctcccagctgagcgagccctcccggctgctgattacgctgctgatgctggtgggtggctcccccggctccacagccggcggattcaaggtcaccactctggcggtatttgtgctggcggcccgggcggtgttccgccggcgggcggatctccagtgcttcggccgccgcctccccacggagacactgcgcagcgccgcggcggtccttatgatgtatctggggctgtttctgctgggcggtatggccatctgctgcgtggaggacatctccctggaggcggcgctgtttgaaaccgcctccgccctcgggaccgtggggctgacgctgggggtgaccccgggattgggcggcgtctcccggttgattctgatctttttgatgtactttggccgcgtgggcggcctgacgctgatctacgccgtcctgccggacagcggcgccgccccggcgcagctgccccaggagcgggtcactgtgggctgagcggtacgcttgagaaaggacgtgtgaggatgaaatcggtactgctgatcggattgggccgcttcgggcggcacatggccgccaagcttcaggagctgcaccacgaggtgctggcggtggacaaaaacgaggagcgggtcaacgaggcgctggacctggtgacccacgcgcagatcggggacagcaccagcgaggcgttcatcgcctccctgggggtgcggaactttgacctgtgcgtggtggccattggagacgacttccagagctctctggagaccacggccctgctgaaggagcagggcgcacgcttcgtcctgtccagggcggcacgggatgtccacgccaaatttctgctgcgcaacggcgcggatgacgtggtttatccggagcgggagaccgccagctgggcggcggtgcggtacagctccgaccatatctttgactacatccagctgacgccggaccacgccatttacgagacggcggtgccgccggcctgggtgggcaagaccatcggccagctgggggtgcgccagcggcacaatatcaacatcctggccgccaagcggggagaggagctcatccccattccgggcggcgactactgcttccgggagggggagacgatgctggttctgggcgcggaccgggatgtacagaagttcctgcacttttgacgcagctgggcggagccgtctgttggcggctctgcctttttcacgccgggacggaaaaggccggtttgcattccctgtcgggtctggtataatggatgtatcacgcaagaaaagagcggaggcgaaggcatggcggagatcctggtggtggatgacgaagcggcgattgcggatctggtggaggtctgcctgaaaaatgagggctacacagtgtacaagtgcggcagcggggagacggcgctgacctgcgtggcgcggcagcatttggacctggccattctggacgtgatgctcccggacctggacggctttaccctgtgccagaagatccgggaggaacacctctttcccatcctcatgctcaccgcccgggtggaggacatggacaagatcatgggcctgaccctggggcggatgactacattaccaagccctttaatccgctggagctggtggcccgggtgaagacccagctgcggcgctatacccggtacaacaccggcgaggcggcggaacccagggagaccgcggagcatgacttccgggggctgcagatctccaggaccacgcataagtgcgttctcttcggcgaggagctggcgctgacgccgctggagtttgccattctctggtatctctgcgagcaccggggacaggtggtgcccagtgaggagctgtttgaggcggtgtggggcgagaagtacatggacagcaacaacacggtcatgagccacatcgcccgcctgcgggagaagatgcacgagccaagccggaagccgaagttcatcaagacggtctggggggtggggtataccattgaataagagaagagaacggcccccgctgtcggaccggggccgccgccgggccctgcggacctggggattctatctgctggcactgacggcctgggtgacggtggtgctggcggcggtcttcctggggtatctggtatgcagcgcctttacgtggtatgcgtgggatccgctctaccagttcctcaactgggtacgggattacatcgtctttgtgtgtatgctggtcatcctgctgggctgggtggctatcagctattccttcattgcccgccccatgcggctggtggacacgctggccgcggcggcagagcagctggcccagccgggagaggagcccattgagctgccggagcccatggaggatctggaggggcagctgaacgccgtccgggaacgggccctgcgggacgcccgggctgcccgggaggcagagcagcggaaaaacgatctggtggtctatctggcccatgatttgaagacgccgctcaccagcgtcatcggctaccttacgctgctgcgggacgagccgcagctctccccggagctgcggagccggtataccggcatcgccctggagaaggcggagcggctggaggacctcatcaatgagttctttgacatcacccgcttcagcctgacccatctggagctggagaagcagcctacggacctgacccggatgctggagcaggtggccagtgagtttgccccccagttcgcggaaaaggacctgcggtgtgaactggagctgccgccccgtctggcatacgactgcgacccggacaagctggcccgggtgttcgataacctgctgcgcaacgccttccattacagcttcccggggtccacagtccggatcaccggacagcaggaggcggataccgtggtcctgacgtttaccaacgaggggcggaccattccggcggagaagctggagcgcatcttcgaccagttcttccggctggacagctcccgcgccacccgcacgggcggcgcgggccttggcttggccatagccaaggaaatcattgccctccacggcgggacgatccgggctgccagcgcggacaaccggatcacctttaccgtccgcctgcccctgcagggggccgccgcaagaaattcgtaagatttccgcaggaaaatcacaggaggtttgcaggaacgtccacagatctgcgggaagcgaatctgatacgatctttccatcaggaaaggcgctgggcgccggaaaggacatgagatggaaagattgcggatattggtgctgttcggcggatgctcttcagagcatgaggtgtctctgcagtccgcccacggcgtgctgacgcacatggacccggagcggtactgccccatcccggtagggatcacccgggagggggcgtggtatgtttacacagggccgctggatgccattcccggtggaagatggcagcgggaggcggcgtgcgtgccctgcactctgcggctggaccgggggaaccaggccctggtgctgttggacggctccggccgggaagtggcttttgacttggccttcccggttctccacggcaggaacggtgaggacggcacggttcagggggcgctggaattggccggtgtgcccctggtaggctgcgggacgctgtccagcgccctgtgtatggacaaggaccgagcccacaagctggcggctctggcgggggtacgggtgccccggagccgtctcttcccggaggactgtgcctttgaggagctccggacggcagccgaaacactgggctggccgctgtttgtcaagccggtgcgggcgggttcttccttcggcgtgagccgggtggaggagccggcacagctggctccggcggtggaggcggccttccgccacgacggcgagattttgctggaggaggccattcccggctttgaggtgggctgtgcggtgctggggaaccgggagctcaccgtcggggcggtggatgaggtggagctgtcccggggcttcttcaactatacggagaaatacaccctccagacatcggccatccactgccccgcccggatcgccccgcaaaaggcagcggagatccgggagacggcgaaggtcctctaccgggcactgggctgccggggatttgccagggtggacctgttcctcaccccctggggggagattgtgttcaacgaggtgaacacgatcccgggcttcacgccccacagccgctatcctgccatgatgcgtgccgccggcatccccttccgggagctggtgagccgcctgatccagctgggggccgagctatgagggcggcgcggtacagccggcggcagatgcgctccgggccgctggtgctggtgaaccgtcagcatcccctggcggaggagccgcggcagctgctgacagcagcggacgagcggtatcccaatatcctgctggagcggcaggccgcccggctgctggccgcctgcatccaggcagcaggcggggcgcgggagatcgtgccggtctccggctggcgcagtcaggcggagcagcaggccatttgggaggacaccctgcaaagacggggagaggcgttcacccggcagtatgtggcggtccccgggtgcagcgagcaccagacggggcttgccatcgacctgggccgggcagcgcgggagatcgacttcatccggcccgattttccggaggaaggcgcctgcgggcggttccggcgactggcgccccggtatggcttcatccagcggtaccaccgggaaaaggagtccctgaccggtatcgcctgtgagccgtggcactatcggtatgtggggacgcctcatgccctgctgatggagcgggagggcctgtgcctggaggagtatctggactgggtgcagacagcgcccaggacgtgccgcctggaacatgggcggagcgcacgggtgttttacatgccctgcgccggcgatgagacggagctccgcttgccggagggctgctgccaggtctccggcgacaaccggaacggatttgtcgtgacagtttgggaggtgtaggtatggcagacggacgccggggcgcggcgttggatctcttccgtctggcggcggtgatgctggtggtggcgaaccacacctccccgctggtgtctgtttccccattgtgggacttctggttcacccgggtgctggcccgggtggcggtgccgtttttcctgatggtcagcggctattttctggcaaaggaccagtggcgcaggaccggcgtctttctgaaaaagacctgtctgctctacggggcggcggtgctgctgtatctgccgctgaactggtacaacggcggctatgggccagcggagtgggtcaaaaagctcctgctggatgggaccttctatcacctgtggtattttccaggcgtgattctgggtgttctagtggccagggggctgctccggctgggctcccggacggcgttgaccgcggccgggctcctttacctggtgggcctgggcggagacagctattatggactgacctgccagctcccggcgctggaggcgctgtacggggagattttccaaatctttgcctatacgcggaacggactgtttttcacgccgctatttttgctgctgggagccgccggtgtgcggtggagcgtgaggacctccgctgcaggcctgtgcgccgccttcgcggccatgaccgcagaggggctttggctccatgggcttcaggtccagcggcacgacagcatgtacatgctgctgccgctggtgatggtttgcctgttttcccttctgctggggctgaatcgcggagaaaggcggagctgccgcaagctctcttcactgatctatgtcctgcacccctggtgcatcgtgctggtccggggcggcgcggaggtgctgggcctggaaggtccgctggtggagaacagcatggggcatttcctggccgtgctggcctccagcgcggcggcgtcctgggcgctgtggctggcctggagcagacggccgctgaaacgctccaataaaggataaaaggacaatatattgtcgaacttcgacagtatattgtcctttttgggcctctcaggcgccttcgcgctccgcgtgaagacggcggagctgctgttcagctgtcatcataccctgctcgtaccggtcgattttctgattcagcaggtccagagaggcctgcatctccgccatccgggacaccagctggtcccgctgttctaccagcagggccttgcgggcgtccagggtggcgtctccctgctggaacaggtccacatattcgatcagggcttcgatctgcaccccggcggcccgcatgcacttcatcagctggatccagccgcaggactcctccccgtagtcccgcaggccgcccctggtgcgggggacaggcgggatcaggccgatgcgctcgtagtagcgaagggtgtccgctgaaatatcatacttcctgctcacttcggcgatggtcatggccgttctcctctcagcgggcggcctgggccgcgtcgttcacacaccgcagggcgttcaggctgcggggatagccgatgtagggcaggcactgggagatgacctggatcaggaaggcattgtcgtttccaatcctcagattggcaccggcgtggctggtgagctggggttcgcagccgcccagggcggccaggaagcagaaggtgatcatttcccgctgcttatagtccagcccccgcgggtgtagtagtcgccgaagcagttgtccgccagccagcggttgatgtggcggctttcctccgggccgctgttctgaaagccccgcatcccctcaccgaagatatccacctgggcctggttgcccgcggccagccgggtctctgccgtggtggtggagccgggctccagcggcagggcgacgccctgctccgtcagcacctgattcgtcacggagaaaaagggacgcacccggccgatccccagataggccacggattgatagagaatctcctttacctggacaggggtgatgccggcccgcagggcggcgggcagcagcacgcggtattcctccacaccctggcagcccagtagggcagcgagaatggccatcatcctggcggcgtcatccaggtccccctggttcaccacctcgtccagggcgaaattggcgaagagctccataaactccggatccgtttcccacagcggggaaggagggccgggaaagaaacgggacaaatagtctttggcagatgcggaaagcgccatactgaaaagcctcctttgcgcctgcggggcgctgtcttttgatgagaacactttagcacttggagtctactccaagtcaagtgctttttcaaatactccgcaggggaatcaatcctcaatatgatacagagaggatatgaccagccagagctgggagaaggggcgcatcaggttccagatgccggcaccctggaaaccgtattccgcgatcagggacagacgggcggaaagactgcgggcgtcttcaaaccagacttcgtgaattgtgccgtctgctgcggtgtagtgaaagaagggggcctgggccgtctcatcgtactggatggccacgtcatgttcaatggccagctcgatggcccgctgattggagatggagggcgcccgggtgacgccctggacaaagggcaggggccaatcgtagccgtagttggaaaggcccaagaagatcttctccggcgggatctccgtcacggcgtagtccagcacggtccggacgttgggcaggggggataccgccatgggcggtcctgcggtgtagccccactcataggtcatcagaagcacgccgtccacagcggcacccacagcggcatagtcgtgcccctcgtacagaagtcccgcctgccgggcggaggtcttgggggctagagcggcccagagaaagaagccctgggagttcaggagccgccgcaggcgggcgagaaaggcggcgtaggccgccgccagctggccggggagaaattcaaagtccacatccagcccggcgtagccacggcggcggagtgtctgctggacctgatccactaggcggtcctggacggcgctgtctgtcaggaccagggtggcccgctgggtgtcgaactgaccggtttctgtcatggtggacagatgcatcaccgggcggacgccccgctgacgggcagcggagaggagagcgtcatcctccagctggagcaaatcgccgtcggcggtgatcccgtaggtgaaaggggtcagataggtgagatagggaagctccgcattcagaagggacatatcaatgtaggggtaggcataaccgttgaaggcggcggcgcccaggggctcgtcaaagtaggagatcaccaggacctgtccgggctggagggctgctccgccgcccagaggccagttgttctgccagaggcggcggactgtggtgccgtatgcctccgcgatggaagccagggtctccccggcccggacagcgtggacctggcggggaaagcggaccaccagagtttgtcccaccgccagggcgccgctggggggcacggcgttgtccgcggccaggcgggcgggatcgacgccgtaggattccgcgatggagccgaccgtctcgccggcttggaccacatggatcgtcatgttggacatcacctcctttggagactatgcaggccggggtggggatatgcggtgcccactggagggagttggaaaatatgacggaagagacggctgcttgacagagcacatttggaagaattgtgacgctttgtcagaacgccgaaatttgattcagagatttgtggatattttccggcgtgccaggagggtcaaaaccgctgaaatagttgacagagacgtggagaatcgttaaaataatgttaaagcttgtgcgttttttaacgaaaaacgggtagacgatgacgtccaacaagcgtgtgccatccgccgttgagggaggaaacacaccacttgctgagacgtctctttttgtatacagcgcaaagagggaggcaaagcgatgttcctgctgtttttcctgctgtggctgttgctgtccggcgggatcagtgtccatacctgcctgtggggcgttgcagtctcggcgctgatctcctggttctgcaagcgggtgctgggctatcagtggcgggtgttctgcggcagtccttccagaatctgggccatggcgcggtattttgctcacctgctggcggagatgctgaaggccggactggtaatcatgcggatcatctacacccgccccaagggcatcgaacccaagctggtgtggttccacaccccgctgaagacagaccgccgcagggcaatgctggcagactcgatcacgctcaccgcggggacaatcaccgtgcgggccgaggacggccggatgctggtgcacacactggacacgccgctggcagaggggattgaggacagttccttccagcagcggctggagaggatggaggcggcccaatggaacaagtgaggacctgggtgctgaccgcgggcgccgtggtgctggcgctgctgatcctggcgacgctggtgcgggcggtgctgggcccccggtttacggaccgcatcgtggccgtgaatgtcatcagtacgctggtgatcgcggagctggtgctgctctccgtctggctgcgggaggactttctggtggatgtggccctggtgttcgcgctgctgagctttctggcggtggtggtggtctcccgtctggtggcggcccggcggcggaaacgcccggagcgggagaagacgggaggaaacgcccatgatcgataatctggtgaccgcagccgggctggcatgtttcctgttcggcctgttcgtgtttttctccgctgtgctggggctgttccggttcgattatgtgctcaaccggatgcacgccgccgcagtgggggactccctgggtatcttctgcgttctgatcgggctgatgctgctgcacggctggtccctgtccgccgcaaagacgctgctgatctttgtgtttttatggctgaccagtccggtgtgcagccatctggtcgcggagatggaggtatccacagtcccggatttggaaaaggaatgcgaggtggaggtacgatgatcgttctggaatacatcctgctggtcggggtgatcgtgtgtgctattgcagcgccgctgtgcaagcggctgctggcatcggtaatcgtgtatatggcgctgtccctgatgatggcggtgctgtggagcctgctccagagcccggatctggccattacggaggcggctgtgggcgccggtgtgaccagcatcctctttttcctgacgctgaagaagatccacgcgctgaaggggacacgggatgagtaaaaaagaggagcagccggaccggctgaaacagtttatctcctgggtggacggagatcgggagcccaaggaccggacactgttcgtcatggagcagcgcccccaccgggaattccgcccgtcagaggaggagttcgagcggcgggaaaaggaccggctgcggaagtttttcaactggtatcccatcgccgcggcggtgatctgcgtggcgctgggaattatcctgttcaccacagtgatgaacatgcccggattcggccaggaagacaaccccatcaacaacgaggtggcggagcgatatctggagcacagcgaagaggagacgggctctgagaacgtggtgacggccatgattatcggctaccgcggcttcgatactttgggggagagctgcgtgctgtttctggcggtgtcggcggtgatgatcctgctgttgcgggaccggaagaacaccagcgagcatgagctccagcagatggagcgggaggagaccgccgtgcagggccgctctgacctgatcctcaagcaggtggcctgggtgctgcttccttttattttcctttttgccatctatgtgctgctgaacggcgagacgtcgccgggcggcgggttttccggcgggactatcctgggggcgggactgatcctgttttccgctgcctttggccccggacacacgcgggtgctgatgaaccagaggcggtacagcgcggtgcggaccttcggtctgctgctgtatgctgtgctgtacggcgtttacatcttcatcggggccaacggcctgcccaattacctcaccgggatgatcctgctgatcgacctggcggtggggctggtggtggcctgcaccgtatatggattctacgccctgttttccaggggagagatctgagaggaggcggagaagagaatgctggaggagatcatccagaaccgctacgcggtcactgctgtcatcctgtttggcatcggcttcacgaatctgatgctgcagcagaatctgctgcgcaaggtgatcggattcaacatcatggactcggccgtcttcctgctgctggcctcgctggggtatattgacgggggcgtcgcgcccatcgtgggggaccggggcttcgacccgctgtacatcaatccgattcccagcggcctggtgctgaccggcattgtggtatctgtgtccatcacggcgttttccctggcgttgatccagcggatctaccgccgctatggcaccattgagatgcgggaactgctggagcgggccaagaaggaggacgactgatgcggccgtttgtggagaactttcccttcttttcgatttttctggctatcctggcggccatcgtgaccgcggccatccgcagcgggcggatcagctactggatcaccatcggagtgtgcgctgcatccgcgctgctgaacggctgggtactggaatacacctatgcagagggagtgagcttcacctacgccatggggcgatttctggcgccgtacggcaacgccatcaactgcgggccgcttcaggcactgctggccgccgtgttctccctggtgatggcccttgctctggcgggcgggcggcgggacctgtttcaggacatcctgccggagaagcagaagttttactttgtcatggtgaacatgctggaggcgtccctgttggcactgacctacaccaacgacatgttcaccgggtatgtgttcatcgagaccagcaccatcgcggcctgcgcgctggtgatggccaaggacaacggccccaatctgatcgccaccatccggtacctgttcatgagcctggtggggtccgggctgttcctgatcgggctgaccattttgaacagcatcaccggctatctgctgatgccctctctggcggaggcagtggcggagctgcggctctcggagagctacacgctcccgctgacggtggctgtagggctgctggtggcgggactgggcgtcaagagcgccatgttccccttccacctgtggctgccggatgcccacggcggcgccaccacagcgtcctccgccatcttgtccggcttggtgctgaaggggtacatcgtgctgctgctggtgatgatcctgcgggttttctccatggagctgatggtggagctgggagtcaccgacgtgatcctggcctttgggctgctgggaatgattctgggctctctggctgctatgcgggagaaccatatcaagcggatgctggcgtattcctccgtggcgcaggtggggtatatcttcatgggtgtgggcctggggagcatcgaggggctgatcgcctcctgtttccatatcctggtccatgcctgctgcaagccgctgctgtttctctgcgccggcagactctccgccgtcagcggccaccacaagagcctgaagaacctgcggggcagcgcctaccgggacattggggcgggcttgggcttcactgtgggggccctgtccatgatcggcatccccctgttcggcggctttgtctccaagctctactttgccagcgcggccgtgcccaccggtatgacggcgatgatcctgctgaccatcgccctgtccacggtgctgaacgcactgtactatgttccggcgctgctggccatctgggtgaagcccccggcggaggatgaggcgctggtcctagccgacgtgcatccgggggatctggctgcggaccgggccttcaccgcggctgccgccatcctgatcgtgggaatttttgtgctgggcattttttaccacccgatcacagacctgatcgaggcgggtgtccggctgatttgagacttgttgtttgtgagggagtgcgcccatgctgttgctgctgcctattctggtgccgctgatcggcgggatcttcgtattccggcagaaaaatgagacttaccgtgactggctggtggtgacgctgatcgtgattaccgccgtgatggtgctggctaactgcacgatgcccacccagcggctgtggctgctgaccatccagggggacttgggcttggtgctgaacagcgactggctgtccaagttcttcatggtgctggcagtgtgcatctgggcgccggtggtggtctttacaaaaccctacatccgccatgcggggcagggcaatcagttcatgggattttataccatgacgctgggggtactgatgggccttgctcaggcggccaacttcgtgaccatgtatatgttcttcgagatgatgtccctgattacggtgccgctggtgctgcacaatgccacgccggcggcccgccgggcaggcttcaaatacttggggtattccgtattcggcgcgggcatggccctggccggctacttctttatcgcctattacttgacggtgccggattttcagccgggtggggccatcgatttctcccgggctgcagagcaccagccgctgctgctggtggcatactgtctgatgatcgttggcttcggggccaaggcgggcatgatgcccatgcagtcctggctgcctgccgcccatccggtggcgccggccccagcctcagccgtgctctccggtgtcattaccaagggtggcgtggtggctgtgatccgggttacttattatatgtttggaccggagtttctggcgggcagctggccccaatatgtgctgctgacgctgacgctggccacggtgttcgtggggtccatgttggcctatcgggaaaagcagctgaagcggcggctggcctattccacggtgagccaagtgtcctatgtgctgttcggcctgatgctgctgacgccggatggcgtccaggcctctcttctgcagatggtcttccatgccctggccaaggatacgctcttcctggcggcgggcgccatcatcttctccaccaactgcacccgggtggatcaactgcggggcatcggccggcggatgccggtaaccatgtggtgcttcaccctggcggccctctccctgatcgggattccgcccatggcgggattcgtgagcaagtggtacctgctcaccgccagcctggaggcaccgatccaggcctttggcgtcgcagggctggtggtgctggtggtctccgccctgctgacggcgggatacctgctgccggtggtgacagagggattcttccccggccgggattttattacggagcggcgggaagtgggagtccagatgacatggcccatgattgcctttgccgcggctgtggtgctgatgggtctgctgcccggcggcctgctgcattggctgggtcttctggcggcccggctgttcccctgacagtggggaagctttgagaagggaggtacgtctgtgcgccaatttctgacattgcccattctggttcccatcgtgctgggaatcgcgctgctgatcctgcagcccaagagccggagggtgcggagcatctatatcatggcggcatccctggcgacgacagcactgtctctggcctgtatcgtgctgacctatctctatgggagcggctttctggcctgtatcatggtgagattcaacgaggcgttctccatctccctgcggatcgacggggcgtccatggtctatggggccatcgtgtccgtgctgtggccgctggtgacggcgtactcgctggactatatgtcccacgaggggcatgagaaccggttcttcgctttttggctgatggcctacggtgtggtgctgggtatcgcttattccgaggattttctgacgctgtatttcttctatgaggtcctgacgctgaccacgctgcctttggtgatgcacgccatggacgagaaggcccggtatgccgggcggaagtatctggtgtactccctttccggcgcggcgtttgcctttatcgggatcgtctttctgctgaattacggcgtgggacacctgaacttcacctacggcggcattctggatcagagtctggcggcgggaaacgagcggacgctggagctggtgtttgtggcggcctttttcggcttcggggtgaaggcggcagtatttcccttccacggctggctgccggacgcctcggtggcacctacgccggtgtctgcactgctccatgcagtggcggtggtcaaggccggcgccttcgcagtgctgcggctaatttactacggcttcggggcggatttcctgcggggaagctgggcccagacggtggtgatgacggcggctatcgtgaccattgtttacggctccgctcgggcgctgcggacaccccatctgaagcggcggctggcgttttccacggtgagcaacctttcctacatcctctttgccctgacgttgatgaccccggcagggatggtgggcggcatgacccacatggtctaccacgcattcaccaagatcaccatgttctgctgcgccggcgccattattctcaagagcgggaaggagtatatctatgagatggaggacttcggccgggccatgccggtggtgtttgccacattcaccgtctcctcctttgcgctgatcggaatgccgccgttgggaggcttcgcaggcaagtggatgattgcggaggcggcagtggcctcggtgaatccgctggcctacgcgggcatcgccgcgctgattctgtccacgctgctgacgacgctgtacatgctgactattgtggtgcgggcctatttcccggtgggagagctggaccgtgcggcactggcccgggtacacgacccggccaggaccatgtggatcccgctggtgctgctgaccgcctccggtgtgattctggcgctgctgtccaacgaagtgatcggctttttatggaacgcggttccgcggaactggtaagggagggagacgatgggaaacattctgctgctgtttctggtcctgttccccatgctgctctctgcctgggtgttcccgctgcggcggcgggacaggagataccggaattggctgatccagatcattcccgcagtggagctggccgctgcactgctgcttctgctgtggcccggggctgccctggagctgccgggggtctttggctttggcctgcggcttcaggccgggagtctggggagcctgctggcgctggtgagcgccttcctgtgggcggccaccggcctcaactgccccagctactttgccgccgccgagggctgtaatcgtttctactttttctggctgttgacgctgggggctctgatgggggtgtttctggcagcggacctgttcacgctgttcgtgttctttgagatgatgtccttcacctcctatgtatgggtggtgcaaaacgagacggaggaggcccggcaggccggacagacgtatctggctgtggctgtgatcggcggcatggcgctgctggcgggcctgctgctcctccagcagctgctggggacgctggagttttctgctatggcggaggcggtatccgcgctgcctgcggagaagcgcgggtccctgtacgtggccggtggatgcgcattggtgggatttggcgccaaggccgggatgttccccctgcacatctggctgccaaaagcccatcccgtggcgccggcaccggcgtctgccctgctgtccggcatcctgaccaagagcggtgttttcggtgtgctcattctctgccggtatctgttctggacagagcttccctggaatacagtggtactggccctgggcgtggtgaccatggtgctgggagctgtgctggcgctgttctccgtcgatttgaagcggacgctggcctgctcctccatgtcccagatcggctttattctggtgggcacagccatgcagggcttcctgaacggcgagaacgccctggcggcctggggcacggtgctgcacatgctgaaccactccctcatcaagctggtgttgtttgtggcggcaggtgtggtgtatctgggaactcactcgctgaatctcaatgacatccggggctgggggcggaacaagccggttttgaaggtcctgttcttcgtgggggcggcctccattgcaggcgtaccgggtttttccggctatgtgagcaagaccttgctccatgagagcatcgtggagtacatccatgtgctggagcacgcgggggccgccgcaggttggttcacgacggtggagtggctgtttctgctctccggcggactgacagcggcgtacatgacaaagctgttcgtggcgatttttgtctccagccgtgctgttggccaacggccggccttgaaggactatatgtcccgggcacccatgcggcgttgagtgtgggcgcagccctgctgctggtgctgggcctgactccgggactgaccatggagcctctggcccaatgggcggggcgattcctgcgggcagatcctggtcacagcgtccattattttgcctgggtcaacctgaagggcgcatgcatctccctagctattggcgcagcagtctatctcctggtggtccgagggctgctgatgcggcgggaggcggatggcatggtttatctggaccgctggccggcccggctggatttggagaatctggtataccgcccgctgctgtcggccctgacctttgtgggggccctctgcgcccgggtggccgcctccgtaggcgactggctggtgctgctgggggagcggatcctctttaccaaggcccccggcatctttgtgccgaagcgggccgagaacttcggcacatacggacggaaacccctccgtttcctaacggaagagaccttctcctttgatctcatgctggcaggcggagggctgatcttcctgctgctgtatatgctgctgtgagtcgacaacggatacagaagaacgcgaaaggccaggaatgccgcttatgcggtgttcctggcccatctttatgggagggagagaagattgtgggtacgatcatagctgtcacggccgcggcaggcatgggagggaccgggctggggggcctggccgcctatctgttccgcagaggtacggacaggaccgtgagtgtgctgctgagctttgcggcgggcatgatgcttgctgtggtgtgtgcagacctgctgaccgatgccattcaggcggggccagggctctccgcgcttcctgcggcatctgccagcgtactggcgggctgcggggggatctggctcctggaggagctggtaagcgggctgcaggcaggtgcgaagcggggagggctctttctggcaggtgtggtgatggcagccgctattgccctgcacaacctgccagaggggatggtaatcggcgcctcctacgctgcggatctggccgaagcgggagaggatgggcgaatgatggcactggtgatcgggctccacaacattccagagggaatggctgttgcagttcccctggcggcaggcggtgccagcagaggacgggcagtcctgaccacagcggtagccggcgcgcccacggtgctgggggcggttttgggcttctgcctgggaacgatggggccgggcctgcagatgctcacactgggcggagcatccggggcgatgctgtacgtggtattcggtgaactgctgccggagtccttccgcctgtgccgatccccagcgcccgtgatggcggcggtgctgggggttctaacaggcatgggcgtggttttgggataaaaagaacccgtcccgccacttggcgggacgggtttgtttcagaaaatagttacagcttacagcttctggagccgggcagcgcgcttcttgccgtaccagacaatgatagcaacgtaagccacagcagcgcagacaccgatgatgtaggcgggcgtccagggaatatggaagccgatctgtgcattggcaatgaaggtcactgtaacaaaggtgtaccaagcaccgggaatcagggggatccacacccacttggccttgctgttctcgaacatccatacggagatacccaggaatgcgaacagggacagggtctggttggaccatgcgaagtaacgccacagcagattgaatccatcggggctgctcttcgcaaagaccagaatcaccgccaccagcgcgaagatgatggcggacaggcccaagcgcttcggcttagagctctgatcgatgtgcagagagtcagagatggacaggcgcagagaacgcagcgcggtatcgccggaggtgatgggcagaacgatgacgcccagcagggcgatgatgccgcccacggggcccagcagatcgcggcagatgatgccgacagtgccggtggccagagaggcattgacctcctgcagacccaggttgtacacgcccatagcggcggcggcccagatcatggcaatgaagccttccagaatcatcatattgtagaaggtcatgcggccctgcttctcgctcttcatggtgcgggagatgatagcggtctgcgtggaatggaagccggagagaatgccgcaggccacagtgatgaagaacacaggaatgaagtgctgcgcggtgaaatactcaccataattgaaggtggcgctctgccagttgtcccacaggttcagcaggggatagcccttgacgaacatgccgatgaacacacccacggcagacagcagcaggatagcaccgaagatgggatagatgcggccgatgatggcatcgatggggaacacggtggcgatcagataataaacgaagatgacaccgtaaatcacccaggtggagacagaggtggcagcaccgtcaaaaccaaacacctgagtggcggcgatgtcgccgggggtgtagatgaacaccgcgccgaccagcagcagcagtacgctcaggaaaatctggtaaacagtgaaaacacccttgttggagtacttgcggaccatgtccggcatctgggtgccgccgtcgcggaggcagatcatgccggagaaatagtcgtgcatagcgccgccgattacgttgccgatggggatggtgatgaatgcgatgggcccgaacaggatgccctgaatgggtccgatgatggggccggtgcctgcgatattcagcaggttgatgaggctgttcttccattcccgcatgggaacgtagtccacgccgtcctgcttggaataggcgggcgtctcccggtcatcggggccgaagaccttttcgcagaacttgccatagatggctgcgcctacgaacagaatcaccaggccgatgagaaaggttgccatagaaaacacacactcctttatgcccagtttcccggacagattctggctttatcatagcactgaagaaaggagttgtaaataatttattcatatttataaagaatttgttaatatcgcagagaaaacaattaaaaattcgtttacctcacctaacaaagttccaaaatttttgtcccttttcaagataagtgttgctatgtataatcgtgaataaaatttgaaatacgtgaataaatagtcacatctgcacgaggataccctttgaaacagggtatcctcttttcatttggctttgtggtcagaagaaatataaatttcaaatcaaaggattgggaggtgcagatacattgccactaattcgctaaatatgatatactttcacaaagagctattgtgcatggaggagttcaaatggataatttatttgacttgaacattgaaaaagttcttgagcattggggtgttgagcatgcaattcgagaaataattgccaatgctttggacgaaatgactttaacagggacgaaagaaatcgagatttcttattctgatggtgtgtgtcatattagagactacggacgcgggttgcaatacatacattttactcagaatgaaaacaaagaaaaacttgttgcaactaacttgattggtaaatttggcgtgggattgaaagacgcacttggcgtattttacagaaaccatatcggagttacaatccattccaaatactcaactatatctcttactatggctgaaaaggcaggatttgacatacaaactttgcacgcagtcttttttgaacccaagtatcctacaatggtaggcacagatgtagtgcttactggtgtaaaacaagctgacctgcaaaaagcgaaatctatgtttttggtatttaatagtgatttggaacttttggaaaaaacaaattatggcgaagtatatacaaataaaggtgatggtaagtctttcatatatgccaacggtgtccaaatagcttcagaagataatttcctatttagctacaatattacaagcatgaatgcgcaaatgaagaaagctctaaaccgtgaaagatcaaatttggggcgtactgcttattcggaaacaataaaaaatattttgaagaactgcgtttctaccaaagtcatgcgaccgctcgttgccgacatagggaatgtaatgactggggcaaataaagacgaaacaggatgggttgatattgcagcctatgcagcgaagactctaaacaaatccggaaatgtagtttttatgacaccatctgagcgggcacaacttacaaatgatcaagtcgagatattagcgcacagcggaagagaactcatcatggtaactgatgcagtattcgggaaaatatcagatgttgttaatacatttaagactgtatccgatgaatataggcagggatacaaatacagatttattgagtacaaaaacttaacaggtgatgaaaaagaaacttttgaccttgtaacaccaattactgaactcgttaataagaaatacaggagaaagataccaagcattaaaatttccgagactattcgtatggatgaatttggctttgtaactcatggcatatgggatccggcagagaatgctataatcatcaagagaagtattttgaagtctaaagaaacatttgccggcgtgcttatgcacgaatttgcacattatgtatctggttatgcagataacacacgagattttgaaaatgtgcttacagagatgcttggctttgtctatagcgagttaagtattaagggggagaaaccaaagaaggttggtttgttcaaaagatggtaaatagtgagaggggcaggaaccattatggttcctgcctcttattatgtcttctgatgaataaatctacattgaagttggctacccaagcagtagcaacaattaacttaaaagggagaaattttttaaggaccggatgtgaacacgaatatttgtgctggacggacctgaaaatatgcgggagttcaggcagtaaaaaacccgtcccgccttttggcgggacgggtttgattttggaagacactgcagcttacagcttctggagccgggcagcgcgcttcttgccgtaccagacaacgatgccaacataggccacagcagcgcagacaccgataatgtaagcgggcgtccagggaatatggaagccgatctgcgcgttggcgatgtaggtcactgtgacgaaggtgtaccaggcagcggggatcagggggatccacacccacttggccttgctgttctcgaacatccacacagagatgccaaggaatgcgaacagggacagggtctggttggaccatgcgaagtaacgccatagggtgttgaagccgctggggctgctctttgcgaagaccaggatcacagccaccagcgcaaagatgatggcggacaggcccaggcgcttggccttggagctctggtcgatgtgcagggactcagaaacagacaggcgcagggagcgcagcgcggtatcgccggaggtgatgggcagaacaataacgcccagcagagcgatgatgccgcccacaggccccaggatatccttgcagatcacgccgatggtgccggtagccagagaggcattgacctcctgcaggcccaggttgtacacacccatggcggcggcggcccagatcatggcgatgaagccctcgaggaccatcatattgtagaaggtcatgcggccctgccgctcgctcttcatggtgcgggagatgatagcggtctgcgtggagtggaagccggagagaatgccgcaggccacggtgatgaagaagatggggatgaagtggttggcgtcaaagtactgaccatagctgaaggccgcctgctcaccggtggctgcatcaacagcccacgcgtcgaacgcgatgccatgccagtcatcccacaggttcagcaggggatagcccttgacgaacaggccgatgaacacacccacggcggagaacagcaggatggcgccgaagatgggataaatgcggccgatgatggcgtcgatggggaacacggtggcaatcagatagtagacgaagataacaccgtagatgatccaggtggtgggatcattcaccgcgccggagaagccgaagacctgggtggcggcgatgtcgccgggggtatagatgaacaccgcgccgaccagcagcagcaacacgctcaggaagatgttatagacggtaaagacacccttgttggagtatctgcggaccatgtccggcatctgggtgccgccgtcgcggaggcagatcatgccggagaaatagtcgtgcatagcgccgccgattacgttgccgatggggatggtgatgaatgcgatgggcccgaacaggatgccctgaatgggtccgatgatggggccggtgcctgcgatattcagcaggttgatgaggctgttcttccatccccgcatgggaacgtagtccacgccgtcctgcttggaataagcgggcgtctcccggtcatcggggccgaagaccttttcgcagaacttgccatagatggctgcgcctacgaacaagaccacgaggccgatcaagaaagttgccataaaaacacacactccttttccttaacccgcggccaggtcctcgatttggacacgcgggcttctggctataagcatagcagatttttggccgcataagcgttaaaaaatagttcacggaaattaagatgtcgctaagaaaacgacagccttatcaagaatgcgcttacttttggggagcgatgcacaaaaagcgcatgaagaagcccggttgggagctcttcatgcgcctgtgcggacggcggagcggatcagctgccctccgccatgcggtagccgacgcccatctctgtgaagagatactccggctcggcgggatttttttcgatcttccggcggatgttggccatgtttacccggagaatctggttgtcgccgctggcccgggggccccacagctccttgatgatgaaatcatacgtcagaaccttgccagcgtatttgcccagcagggccacgatgcggaactcgctgagggtgaggtggacattctcaccgcggacacggacctggtgcttattgtagtcgatgaccagttctcccactgtataggtgccgttccgggcgatttcgtcattaccggagatggtgcgggtgtggcggatcgcggtgcggacccgggccaggagttcgtccgtgccgaagggcttggtgaggtagtcatccgcccccagatccaatgcggcgaccttgtcccgctcatgggagcgggcggagaccaccaccaccggcaggctggaccagctgcgcaggctgcggaggatgtccagaccatccatgtccggcaggccgaggtccagaatgaccaggtcgggacagtgggaggagatcatggaaagcgcctcctcgccggtctgggcctgcatggcttcatagccgttgttgttgaggaccgtggaaatgaagtgcgagatgctcttctcgtcctcaattaccagaattttttcacgaatcgtcatgatacttcctccttagtgagcggcaggcagaaggaaaattccgccccggactccagattttttgcttccaatgtgccgccgtgggcacggatgatagccatgcagaccgataggcccaaccccatgttccgctttccgtcgccgggggacgagtcctcacagcgaagcgcaccgctgaacagggtgtgcagtttctgggggggaatgccctggccgttgtcctgcacgtaaaagcgggcccaggggccatcccgctgcgcggacagggcgatgtgcgtggtggttccgccgtggaacacggcgttctccatcagattggacaggacctgcatgatgaggatggcgtccatggggaccaggagcagctcatccggcacgtggacctccacggacacggcgggaaaccgttttcggaatttgcggaccgcctcgtccaggacttcctccgcagcctccggctccttggtgattttggccgattcgttgccgatccgggtgatggagagcagattttccaccacgcggatgagccactgggcgtcatcccgcacatccaccagaagggactgctgttcggccggggagagggcgggattttccaaaatggcggaggtggcacccatgatagaggtcagaggggtgcgaatgtcgtgggagacggagcggagcagatccgcccgcatcttcaccttttcgttttccatccggaggcggtcctgctccttggtcttggtggtcagggtgctggtgaccagcgagaccaccagaaaggtgaacattgtcagcggatagccggaaatggtgaagttaaacgccatatagggatatgtaaacacatagttgacgccgatgacacccagcaccgccgcaatcagcccgaagagatatccgctggtgaagcgggagatcaggagcacggccagcacatagaccggagaggcaaagccgtcgatggtgtccgccgtctggtgcagaagggcgcaggcccccgtggcgcatagaagaatggcggcggagaccagaaggtcgcgccaggagaaggaaaaggtacgcttcaaactggaacgggtgatcttcacagcaggtcctccttacatctgtggggcttgaaacattattatagcagaaagaggtgttaagattccactaaaaaacgttaaagaacataggcgggaaacctgtggatttttgcatacgtttaacaagccccaaatggaccttgtcagcggttgaacgacggaatgcgtataataatggatggcagggagctgccgaaaaacaaaaggagtgtgtatcagtatggaggaaagactcaaaacatatctgcggccgggagagcaggtccgctggcagggccgtcccgccccgttttcgcttctggaggcagaggcaaaaaagcagatcctgctgaagtggggactgacggtggcactgggcggcgggctgctggccgtgtatctttccgggaccgaggcgcccagtatgggatttatcggcctggtgctgctggtggctgcggtgattctgatctcgcccgtggcggagcgccggaacctcatgggggagcagtattggatcaccaaccagcgggccattctgatgacccgggacaagacgtttttctacatggaactgtctgacatcgacgatcttcaggtagtgggtggaaccacaaagggaaagagcttggttctgggcagatgcctgtttgaggaggccaagaagctgctccgctggcgggcctgccatcccaaggtcgacgtccagagccatgacgagacggaccgggccctggggatgattttctatggcgtccagggagccgaagcggcggcggagctgctgcgacagggcagagacggcgaggcagcctgaccggctccaaccggcggctcacccagccatacaattgaatctggagcgcaacacgctgtaccgcggggatctcctgcccgcggtacagcgtttttttattattaagtcaaaagagatgcccggcggcgtgcaacttttggccggaaggcggttattatcgaacgactgagaaaggaggtacgcgtccttggagaaattgaaggggcaggccgaagcattctgccggaagtatctccagtgcatggacccggaccaggcagcggcaatggctggctgcgccgatggatacgccgtgctggagacgaagatggtgcgcaggcggctggagcggatgcgggaggcagcggctgggcaggtgcaccgggaggatgtggtacggcgtctggcccagctggctttcggccgggtgaatgatgcggcgcggctggccctgcacagcgaagaggcggatttggagacgctggatctgtctgccgtggcggagctgaaggtgacggacaagggcggcgtggaagtgaagcttattgaccgcatccgggctctggaggctctgtacggactcctgagcgaggaaaaggcggagggggccggagagctgtaccgggtgctgacggaagctgccggggaggaaggagggtgggacgacggctgagatcatgcggttttcccaaaagcagcgaagggtgctgacctggtggtgccgcccgggagattgggaggccatcatctgcgacggggccgtccgcagcggcaagaccttctccatggggctctccttcttcctctgggccatggccaggttcaacggacggcagctgggactgtgcggaaagaccatcacctccctgcggcggaacctgctggcggagctggtgccctatctgcggcggctgggcttcgactgctgggagcggcggtcggagaacctgctgaccgtgcggctggggggccatgaaaaccatttcctgctctttggcgggcgggacgagtccagcgcggcgctgatccagggcagcaccctggcgggggtgctgctggacgaggcggccctgatgccccggagctttgtggagcaggccgtcgcccggtgcagcgtggcggggagccgcctgtggttcaactgcaatccggagaaccctcagcactggttttaccgagagtggattttgagggcgcgggaacggcgggccctgtaccttcatttcaccatggaggacaaccccgccctgtcgccccggatccgggcccgctatcgcagcgcctactccggcgttttttaccggcgattcgtgctgggggagtggacagccgcccaggggcgggtgtacgacttcttcgaccgggaccgggacagcgtgcctgtgccggagggagattttcaggagtggcggatttctgtggattacggcaccgccaacccggcctccttcggcctgtggggccggcagggagagatctggtaccgggtgggagagttctactacgactcccgccgggagggacggcagaagaccgacgcagagtatgtccgggacctgcgggagctggcggagggcagggagatcacaagggtgatcgtggacccgtcggcggcaagtttcatcgaggcgctgcggcgggagggattccgggtggtccgggcggacaacgatgtggccgacggcatccgggtgacggcggacctgctgaagcggcggcggatcatgatctgcggcgcttgcgccgactgcctgcgggagatggaaacgtactgctgggacgacaaggggcggcgggacgctccgaaaaaggagcaggaccacgccatggacgatctgcggtacttcgctatggatctggcggcggaagagcagaatggctttgcggccacctgggtggagagacgggcctgagggaccgcggtaaggaatggacgggaggtttggaagttgaagtggtttcggaaacagacggcgccggcgggagcgtcggtccagctgcgggagacgggataccacccatttggactgctggggcagtatgtgcccatgcgcagtggggagatccggctgtaccgggcagtacgggaggcggtgccggtggtggacgccgccatctacaagctgatccggatggtgggcggtgtgacggcggcctgttccgacccggcggcagagcgggggctgggggaattcctccgcacggtcccggctggacgggggcagtatggggtcgatgcctttctggagggctacctggacgctctgctgacctgcgggcgagccatcggggagatcgtgcccgcagcaggaaaccgggagattgcggccgtgctgtggggccgggtggaggatattgagattcgggagggagaccatcccctggcatttacaatctgcggccccgacgagcaggggcggatggggccgctgccctgtcaggacttgctgctgttcacgcctctgaatcctgaggcggacagcccctatggcgtgtcccttctgcgggggctcccgtttttgacggatatcctgatgaagatctaccacaccatcgggattaactgggagcgatgcggcagcctgcgcttcgccgtcacctgccgggacgacggaaacggccaagcggaggagcggagccggatgctggcaggagagtggtcccgggccatgcaggataccaggagcggcagcgtgcgggactttgtggctgtgggagatgtggatatccaggtcatcggcgctgacgcgcccgtcctggacagcgaggtgccggtgcggcagattttggaacaggtggtggccaagacggggatcccgccctttatgctgggactgagctggagctccacggagcggatgagctcccagcaggcggacatgctcaccacggagatcacggccatccggcggaccattacgccggtggtggagcggatctgccggctgtggctgcggatgcacgggtatacttgcggctttgaagtcctgtgggaggacatcaacctccaggacgaggtggaggacgcccgtgcggccctctatctggagcaggcgcggaagctgcggcttgagaacgacgcggcggaggcggccgcgttccatacaaggagagaggtatgaaagaactcgaaaaaaatctggaggcaacgggaggcgtgccggcggaggcagagctggcggcgatcaaccgctttgccaagtcacccctgcgggcagaggaggtgtacaccttttccctgcgactgtgcgacaacgaggtggaccgggactgggagcggttcgatacggcggcgctcaacacactgggcgacctgttcgtggggaagagcggcatctttgaccaccagtggacggcggaggggcagaccgcccgcatctaccggacggagatggtgcgggagggcgcccaggtgaccgcggtaggggacggctactgctggctgaaggcctgggcttatctgctgcggacggagaaaaacgcggatctgatcgcggagatcgagggaggcatcaagcgggaggtcagcgtagggtgcagcgtggcccggcgggtgtgctccatctgcggcgcagagggcggcacctgccagcacacgccagggcagcggtacggggagcagctgtgctacctggagctgcgggatcccaccgacgcatacgagtggtccttcgtggcggtgccagcccagcggaaggcgggggtcctgaagcggtacggccacgagaaccaggggatggcacagctgagggcccaggcggagctggggcggaaatacctgcgggagctgcggcgggaggtgacgcggcttgccatgctggcggacgacagcatggacggcggcgccctggccaaggcggcggagcatctggaggagccggagctgctggagctgaagcgggtctacggggcccaggcagcccgccggttcccgcctgtgccgcagctgcggagccggggagcggcaaaaacagaggacgagacagaatttctgatctaagggaggatgaagcatgaagctttcttatgaggggatcggccagtgggccgccaccttcgcctgtgatgatctggcggagggggagctggtgaaggtcagtgccaacggcacggtggccgcctgcgcggcgggcgacgatttctgcggcatggtgctttctgtcggccggggcggcgacgcctgcgccgtggccctgggcggcatggtcaccgccgggtacaccgtaccggcagaaggagcggcaccggccctgggctggagcggcctcagcgccgacggcgagggcggcgtccaggcggacgcggacggcagcacctatctggtggtggatgtggacaccaccgccaagaccgtgacctttgtactgtgaggaggagagagacgatggcatatcattttgagaacatcaagctggaaaagggaatgtacggccgcagcagccgaagcttttcccaggccctggaggagctggaccccagcgaacactaccggggtacgcctctggaggggctggacgcctttcagcggcagctgaagcgctttgacatccatgtaaagggcgcgggcagcgacatggtagagaagttcttccacacctccgactccgccgtgctgttcccggagttcgtctcccgggtggtgcggcaggggatggaggaagagagcatcctgccggccatcaccgccacggtgaccaagttcgacggcatggactaccggtccatcgcctccgtgcccagcgaggaggacaaaaagctccgccgggtggaggagggcgcccggatcccggagaccaccgtccgcacccaggagaacctggtgcacctctacaagcgggggcggatgctggtagcctcctatgaggctatccggttccagcggctggacctgttttctgtgactctgcggcagatcggcgcctacatcggccggatgcacctggaggacgccatcgaggtgctgcgcaacggtgacggaaatcagaatgccgcacagcagtacaccatcggcacgaagcctatcaccggaaccaaggggacgctgacctatgacgccctgctggagttctggagccagttcgacccctacaccatgaacaccatgctggtgggcagcgacgtgatgctggccatgctgaagctggatgagttccagaatcccctgacggggctgaacttccagggcaccggcacgttgaccacgcccctgggggcaaaactgctgcggacctctgccatgccggcggggatcctgatcggcctggacaggaactacgccctggagcagatctgcggcagcgagatcacggtggagtatgacaagctcattgaccgccagctggagcgggcggccatcacctccatctccggatttgccaagctgttcacggaggcatccaaggtcctggtggtatgagcggggcacaggagacggtcctgaccctggcccgggaactctccggggccggggaggcggaagaggctctgctggaactgctttgtcaggcggcggagcagcagtgggagaagcggctgcggccgggaatgacggcggaggactgcggcaaggcgttcccctgcgccgtggccttcaccgccgccgcggacctggcggcggcgcggggcggtgaaggcgtgtccggcttcacagcgggcagcgtgtccgtgcggatccgcggcgcggcggagagctgcgctttggcggagagcctgcggcgcacggcggaacggctgatggcaccctttgcggtgccggacgatttttgctttcggggagtgagaggatgacagactgggtgcggcaggtcctggagcgatatggacaggatgtcaccgtggacacggcggacggagagcggaccgtgcgggcgtttttacagccgatgacggagcgggatgaacgggcccgaagtgacgttacctccatcggctgggtggatgggcggctgtggctgtatctggggcagacggccctggaggagggggaagccctggcctgggaggccacgcgcttccgggtgcgcagctgcaggccctactacattggtaacgcgctgtcccactactgggcggcgctggaacaggagcgggaggcggcggaatgcgggagctgagtcagatccgggatgcagtggtctccgccctggcggcggagggggtggcggcgctggacgcctacccggaccagcgggccaggcggtatggctgcccggtggcagcggtggctgtggagaccgcagagagccggaccgtgggattctgcaattatctgggcgaggtcttcgataccggggccggcgcaccgcgggagctgtatggaaagcagctggaggcggtgatctccatagagatccggggacagcgggctgcggactgtgaacagggctgtgagacggcggcggaggtgctgctgggaaggctgcccgccggcatccgccccggtgagctgaactgggaagccctgacttgggagcgggagacagggctgttcctgcggcggggaaggctccggtgccgggcgtatttcctggcccgggcggaagagggcgacacggtatttttggactttcgattgaagggagcagtgaccacttgagcgagacaatgcatgagcggccgggggtgtactccagctatgacgcgtcaacggtggtatccgccgggcgggccgccaaggtcattggcgtggcggccaaggcggtgaagggcaccgccggagaggtggtgaccctgacgggctatgccgcgggcgtggcggccttcggcgaggacgcagcggatacgccggggatgagcaccatcctgcggctgctgtttgccaatggtgcctccactgtggcggcggtccgggtggcggaggccggcgcggtgaaggactaccaggacgccttcgcggccctgggcggggaggaggcccggattctggtgtgcgacagcgccgaggagacggtgcagcaggcgctgcggactgcggtggaggatgcctctgccgcccggatggagcggatcgccgtggtgggcggcgacggtgagtcggcagcggagctggtgacccacgcggcggcgctaaacagcgagcgaatggtgctggtggggcccgatgccctggacagcggcgggaagacgctgcccggcgtgttcgccgcagcggccctggcaggggtcatcgcctccggacgggacccgggagtgccgctcaacggggcggagatccgggggctggggggcctgggcaccgcatacaccgacaatgacatcgacctgctggtgcggggcggcgtgacgcccctggagagcacggcgggcacagtatccccggtgcgggggatcaccacccggaccacaaccggcggtgcagcggacaccacttggcgggagctgaccaccatcctgatcgtggacgatgtgatcccggcagtacggcaggccctgcgcagcaagttcgcccgggccaaaaacacggcccaaagccgcagcgccatccgctctcaggtgattgtggagctggagaagaaggtggccgaggagatcatcgacagctatggcgaggtgacggtgacggcctcggaggatgaccccaccgtgtgtctggtggagttcagcttcgcggtggcccatgggctgaaccagatctatctgacggtccacatcacggtgtaaggaggagacggtatggaagcaacgggatttcccaccagcgcggacatctatctggagctggatgggagaaagatcgcggtggtgcagggctacaccgcccgggccagcaaatccagccagagcgtagaggcgttcggcgagagcgagccggtggccaccatcgagggtcagcggaagtacaccctggagctgacacggctgtacgccactgaggacgcggtgacggacggcatcaatttctatgacctgcgggatttctccctggtgatctgcaagccggaccggaaggtcatttacagcagctgccagtggagcgccattcaggaagagggccagctgaatgccatggtggcagagaaggtgaccgtggtggcctccaagcggatcgagaccacggcatgatggaggaactggacgagctgcggccgcccacggcctggcggctgctggagatctggcgggggacccgggagctggcagaggagcccctggaacgcgccctgctgtgcaacgcccaggtgctggcagagagctgcctgcgccaggggaagccggtgttccccgacggcgcggcggtcctggtcgggctgaccgccggggagatggaaacactgctgcgccgtctggcgggggaggaaccctcccccgctccggcggcggtgaaccgggactttgatcaggggcggttccaggcgttgaaggagggctgagatggaatacatccgggagatgctgctgcggcagcggaccgccctggggcggctgatgctgggcggcggaagcgcggaagagccggagaccgcagccgcctctccagccacggagagaacgtctccggcagcgcctgccccatgggagacggacgggacggcgtctgggaccggcggatgggagattcgtgggaacagcttcgcgggcgctggggccgacaggcagactggccccacttcggcgggggagacgctgcggctggtcctggcccggaagcgtgcagaatggcagtatacggccgccttcggaccggctggcaccggagagaccgccgattctgccgggaggcggaatcccatgacggaggatggcggtctgtctgatggaggcggggcaacaatgcccggcggaggcgaagcggaggagacgttctattttctgccgggacgccgggactccggcgcggcaggaatgatggagagcgccagggcgctgtcccgcacggtgcagcgggacgcccgccggtatgacggcggattcccgctgtatgactgaggaggtgagaatttgctgctgaaacccatgcgctataaggactacacctggcctcacaacccggagagctgcgcggtggagtaccggcggcagatagcagcccacaagatccccctggggggctggtacctgcaggatctggggcggacataccgcattttccggggagagggtacctttgcaggggagcgggcctacgaggagttccagacgctggcggaggtctttgaccagaccgggccggggctgctggtgcacccggtttggcggacggtcagcgcctatttcgtgaccctggagctgatggaggagccgctgccggactatgtgcgctaccgcttttccttctgggaggacagcacggcctccggcgggctggtggaagtgcccgtagaaggggagccagagggcggaacggacccggagattcccgccggaggctggggtgccgtccatacagtgcggaaaggagaaaccctgtgggggatcgcctggcggtacggcgtggcgctgaccgccctgatcgcagccaatccccagatcaagaaccccaacttgatctacccgggggatcaggtgaggataccatgagaggacggatcatcaccagcgaccaccggatttttgagctgccggtgctgctgcgctggaatatcacctacaccggcggcgtgccctgcgacagctatgaggtcacctgcgtgtacgacaggaccatggcggagctgctgcatctggcggcgggtttcctggcgctggacgagaacggcggggtgctgctgcggggcatcgtggacgagtacgaggtgaagctgacggcggcgggactggcggtgaccatctgcggccggggatacgccgcccggctgctggacaatgagtcccggccggtgacgtaccagggagccacgctggccgagatcgtccggtgccatgcggcgccctacggcatttccagcgcggagatcgcgccggtgtcggcggactctgtttacaccgtggccgccggcaccagtcagtggaaggcgttggagggtttctgccggacctatgggggcttttcgccccgcttccggcgggacgggctgctggtggcggcgccggagcgggacgacgggcggcggatcgtcatcgacgggaccagcccgatcctctcctgcaccctgcgggaggaccactacggtgtgctgacggaggtgctggtcatcgacaagacccggaacgtgtcctacagcgtgcagaaccgggacatgctggaccggggcggccagtgccgccgggtggtctacaccccggggcagagcacctgggctgccatgcggtataccggggagtatcagatccggcggtcccgggaggaggaactgaccattgagctggggctagccgggtgtttcccggcgtttcccggggacacggtccggctggaactggaggccatgggcctctccggcgagtaccgggtggccgaggcggaaaacacggcctccccggagacgggagaggtctgtacattgatactgagggagcggatatgagatgtggctatcgagacagatgaaagcgccggcgcccacggcggacgcggatctgggcatgaccaccatcaccggagacagcgtgggcgtggtcacccgggggaggtacgggcgcttccagtgtatggccccggcggctatgtgtggatgccggagagcggcgctgcggtactggttatcaaaggtggccctggcggggaggagcagtgcgtggcaggacagcagcaggctttgatcccggaaggcatgggaccgggggaggtctatctcttcacccccggcggaaacagcgtgtacctgcgcagcggcggcgagatcgagctgcagggcaaagtgcgcatccagggcagcctgacggtgaacggggagccctatgcgccctgcgagagctgaggggggatggagatgggactttccctgcggaatggagattatgtgcctgacgggaccggtggcctgcggcggaccgagggccgggaggccctgttggagcaggttctcttccgcctgacagcgcggcgggggaccttcccattcctgccggagctggggagccggctgtggcagctgggacagctgcccgccgccagacggcagagcgcggcggaacaatatgtggcggaggccctggcggcggaaccggggctgacggtggagcaggtgattttgacggaatccggcggcggccgggcacaggtgacggtcggcctcacctggcagggagaggctctgtccgtcaccgtggaggtatcgtgagaggagcggttgtttgaaaacgacagaggagatctaccagacgctgctggcggccttcgcccagcgggcgggcttcacaccggaggcagactgcgatctggccgtgcggctgtacgctgcggcagcggagctgcaggccctgggcatccagagcgagtgggtgctggaccagagctttccccagacggcccggggcgtgtatctggactaccacgcccagatgcgtggcatcgcccggacggcggccacgaaggcggtgggaacgctccgcttttctgtggagcgggcgccgtccacggctctgagcatcgccgccggaacggcctgcatgacggagggagagacccggttccaaaccacggcggaggcggtgctggcagcaggggagctgtccgtggatgctccggcggaggccttggagcctgggcggagcggcaatgccgccgcggggaccatcgtgatcctcaccgcctgcccggtggggatcaccggatgcaccaatccggcgccctttaccggcggcagtgaccaggaggacgacgcgagcctgcggagccggattttggagagctatcagcggctgcccaacggggccaacgcggcctggtacgagcagaccgccatgggccatgagggcgtggcggcagcccgggcagtgggccgggcccgggggatcggcacagtggatgtatacatcgccacggcggccggactgccgaatgggacactgctggcggcggtccaggcggacctgcaggagcggcgggagatcgccgtggacgtgcaggtcaaggccccggcggcggtggagatggacgtgtccgcggagctggccgtccgggagggggcggacttctccgcggtgaaggccgccgcagagcaggctctggcgagctttttcagcggccgcaggttgggcgggccggtactgctggcggagctgggggacctgttgtaccacgtggagggcgtggagaactaccgcctgctggcccctgccgccgatctggcggcggaggacggaacgttgcccatgctgggccgggtgacggtgacggaaatggaggcggacgacgatgtatgaggcgcacctgcgcagcctgctctcaccgctgggaatctatgacttggaagagcactccgccagcggcgcggccgtctgcgcactgggaacagggctggacacagtcagccgccggctggaggagatcgagcgggaggcgctgactgccacggcggagggagaggggctggcccggcgggaggccctgtttgcccgccgccccgccgccgtcacggcagaggaccggagggccgccatcgcggcccttctgcagattgacggggacagcctgacgcccgcggccatcgaccggacgatccggggctgcggaatccgcgcccgggcgctggagatgggcgggggacagctgcgggtgattttcccggaggtggccggggagccggaggacttcgaccagatccgaaagatcattctggacatcctgccctgtcacctggaagtggagttttacttccgctatctcacctgggcggagtgcgaggccgccgggtacacctggggccaggtggaggcggcggaatacacctgggagagtttccagctggcggtaccgccggagcgatagcgcaacgaaaaaaggccgctgcccttacgggcggcggcctttctctgcgccggaagagactgggcgggctgctgtctgaaaaccacatcaaagcagaaaaagacaaatggttttgtggcgcggacaatatttttttacacttcgcagattgcaaattctgggatttccctgtatactgcatctatcgagacgcataccgcgtttggagacaagcataccccgtcacatgaaaaggaggaaacacgttatggcgaatttgacactgtgggagcagatcaaagagttgaagtcccccaagtacaagtgggtggacctgacccatgagttgagtcctgagacgccccattggttcggcttcaagcccctgcaggcggacctgctgttcgactatgcggagggcacgcctgaggacatgatggcccctatgcgctgtatccagtacagcgtggccagccagtacggcacccacaccgacgtgccccggcacttctggggcagcggccgggacatgagcgcgatcaccgtccaggagctgatgtatcccctggtggtcatcgacaagtccgccgagtgcgccgccaaccccgacttcatgctgacggtggacgacctgaaggcctgggaggcccagtacggcaggatccccgagggagcgttcgtggccttccggtccgactggtacaaaaagcccaacctggacaatcccgatgagaacggcgtgccccattatcccggctgggacaaggcggccatccagtggctggtggaggagcggaacatcggagccatcggccacgagccggcggacaccgatcccggcttcgtcaccaccaaggagggcgcctatccctatcccggtgagcagtacatcctccaggtggaccggatccagattgaggtcatgcggaatctggaccaggtcccgcccgtgggcagcctgattgtcatcggctttcccaagttgaaggacggcaccggattccccactagatgcttcgccatctgcccggtggactgatccggacccaacaggcgcggcagagctgcactctgccgcgcctgcgcttctttacactcaaacgtttttatgctatcatgaaaccagcttatttttacaggaggatcgcactatggcactggaatttgatgaacagctctcccggctggaaaagcccaaccgcaatgagatgaccaacaaggaatatgccgtctttaacgagaacgtggagaccatggagaagaactggggctttatcaacaacctgttcaaggtcctgcctctgaacgcatcccagtacatcggcttcctggacttcaagggatccctgttcaacccggacacctgctacctcaccaacgcggacaaagagatgatcggcgtggtagtctcctccatcaactgctgctcctactgcctgaccacccacggcgatgcgctgcggggctataccaagaatcccatgttggtggataagctctgctacaacttccgctccgccaaggatctgctgacggagaagcagtatgccctgtgcgagtatgcctggtatgtcaccaagcacgccgacgagatcgacgagacccagatcgagaacctgcgcaaggcgggcttcaacgaccacgagatcctggaggccgcctttgtggccggcttcttcaactacaccaaccgctgggtttctaccatcgccccagtggccaatcccggtcacttcagccacaaccgcaatttcgagggctgacccatggcgtacaaaaagctctttgaacctggccgcatcggcggcctcaccatccggaatcgggccgtcatgtcccccatgggcacagacctggcggacattcggggcaacgccacaccccgtctgatcgcctattacactgagcgggccaagggtggcatcggcctcatcatcaacgagtacaccggagtggacgacgtggactccatccccacccagcacaacctgcggatggcccaggactacaacgtccaggaggcggaggagctgacccgctccgtccacgcctacggcgccaagattttcgcccagctccaccacggcggcgccacctccaaaagcgccttcaccggtcggcagaacctgagccccagcggtgtccccatggcgcccggggcgaggtgccccgggagatgaccctggaggacatcaagcgggtgcaggagaagttcatcgccgccgccatccgctgcaagaaggcgggctatgacggtgtggagctccacggcgcccactcctatctgatcgcccagttcttcagcaagtactacaaccgccgcaccgacgcgtacggcggctccctggagaaccgctgccgcttcatcgacgagatcatcgccggcatccgagccaagctggggcggtatcccatctcggtccgcatctgcggcgacgagatgaccgacgagcccggcttcctcacgctggaggacggcctggagatcggccgccacctggaggcccagggcatcgactgcatcaacatttccaatggcagctcctggaacggcaacgccaactgcgagcccttctcctacacccccggctggaagaagcacgtggccaaggccttcaaggaggcgctgtccattcccgtcatcgccaccaacaccatcaaggacccggatttcgccgaatctttgctggaggagggcgtcagcgacttcgtggccctgggccgcagccagttcgcggacccggagttcatgaacaaggccagggccggcaagccggagagcatccgtaagtgcatcggctgcatgtactgccgggagcggctgctgggcaacgccatgccggtggagtgctccctgaacccccggctgggccgggagtaccgctaccgctggcaggacctccagaagaacggcaacagccgccccgtggtagtcgtgggcggcggccccggcggcttggagtgcgccgtcatcctggccaagcggggcttcgccgtgacgctgctggagaaggaggccgccctgggcggcacgttgaacatcgccaagctgccgccccacaaggccaacctccaggacgtcaccgacgtgctggcgctggaggccagggagctgggcgtcaccgtgaagctgaacaccgaggccacgccggagaccgtggcggccctgcaccccgtgggggtgtttctggctgccggtgcgccgccggtggtgccgaagtccatccccggcatcgacaaggccgtgctggcggaggacgtcatcctgggtaaggccccttgcaccggcaaggtggtgctggtgggcaccggcctgacgggcctggagtgcgcggagatgatcctggagcagggccacagcctcgccatggtggagatgaaccccaccgtgggccaggggattttcggcgtggtgttcaacgacatttacagccgtatcaagccctatgatccggaggtctacaccagccacaggctcactgccgtcactgataccggcgtgaccgtggaggacatggctaccggtgagaccaagaccatcgccgcggacaccgtggtgctggccatgggcacccacagccaggaggccatggaggcgtcttaccgggccgccggactgaacgccattctggtgggcagcgccgagatgccgggccgcattgccggtgctacccgggatggctttgaaaaggcatggggcttcgaggcagagtgatttggcaggctccccggaaaggggccggaacgggcacagcgattcccgcatgatccggcgcaccgggaataccggcaaatgccgctgtacatgaagctttttgggcattatttctaatcgcacacggtaaaagagaccggacagatttctgtccggtctctttttggcagggtcaggcaaacggttcagcacccgttcaggggattcacatccccctccggcggcacgatgcacagggccatcagctgccccttgccggtattgccgaagttgtggcgcacgccgccgggcacatggacccaggtgccgaactccaggggcacccgttccttgtcgatgaggaaatagccctccccctggatgcagaggaaccagtgtggccaggggtgggagtggacactgctctcggcctccggctccagagtgaagaggcgcatcacatagtcgttccagaaccggccgtcaggcccgaagacgatcttcttggtggaattttcaatgaagtgtccgccggtcaccaccggcagatcccggatgttgccggaatactcgctcatagacagatcctccccttattttgataacctcagtatagaatctttgggtggaaaaatcaagtgttctccagagaggcggcatagcggagcacgttctccagtacaaagtcgggaaagcggcagtccctgccgcacacccgcgtgcgctcccggggcagccggggcagcagctccgcgtccgggatcagggccaggtccgcctgacggagcatgggcacgtcgatgacgctgtccccggcggcgatcacccgctccgggccgaaccgctccaccgcccggcggagagcggtccccttgtcgatccccggtggaaagaaatagaccttccggccggagaccaccgcctggagggcggagccgccgcaccaatcccgggccacgcgttccgccgccgggatgtccggataagcggcgtagacgtacacaccctccacgcaccgcacggaggtggccccgccctgccgggtcagatgatccaggaccgcggccagcgcctcccggtggtcccggaccagcgcctgggacgcggcgtaccacgcccggtccacctgaccgtcccgcagcaggacggcgccgttggcggtcagggcaatcctgggcgccgtgccgtccggccactggatgcgctggtactgctcgatggaccgggtggtgatgggcagcagatggacccgctggacgacctggggcagcaggtctggcgtctcccgggtgaagaagccctgctcggccccgttcagacgctccacacaccggtcctcgggctgccggtgccggtgggagaagaggagcgtgttgtccaggtcgctggcaaacagaatcgttcccatggctatgtgtccgccaggtcccggatcaggccgcaggcccggtagttctccaggggatactccaccagctccgcgcccttctccctggccagttggtagatgtgccccagatgggcttcgtctcggaggctgtggaccagcaccttccagggcacccgccgcagcaggacacgggtggcctccccgatgctgggcttgatgagattgatgtcccggatgccgaagtccgccccgatccggtgcacctcctccagtccggcccggccgctgcgccggggcgggggaacggcgtcggcacaggcggggaaatgggcctggatggtgtcgatgaactggtacgtcaggtcctggtccttcagctcccggtagaaggcagcgccgtgaaagtccccggggctgatgatgtcgccgcggaggaacgtccggctcaacaggccggacacggtggagttcaggcaggagctggcgatgaggaaatcgtcatgggtgccgcagatggccgctacgttggccgggtccgacaaaactgtcagccccggcgagacgccggggtagtccgtcatggctgcgtccagctgccgctggatggcgcccttgccggtccagccgtccacgaactggatatctccaggggcgtggcggttcaggagataggccatggcattgcggtcgatgccccggccccgaatgatggagatggtgtaatgggggaggtcggcaccgtaccggccttggagatagcggcggatcagaatgccgatgggcgtccctgcccgggccagggagaccagggcgcactgccttcccctgctctcccagatctgctccgccgcccgggccacagcctccgctgtgatgccggcgtaccgctccagggcgtcgtgataggcggccagataggccggggagggctcatactccaggggcagcatctccgagtagtggacaccgctctggatcctggcctcccgctcccgggtgcccaggggcgtcaccaggccggtgatgtctttcagcaggatggtcacatcctgactttgatatgtgctgaacataagatcctctcaaattctgcagagatagagtcggggacagcccagctgccccagggccgccgccagccgggtgcaggcggtcccgtccaccgccgcgggcgcatccgtcaccaccagagcggcgtcataggcggctaggtcatagagatatgtcttccggtccccaccgtagaagctgggcagcagcaccccgtttcggatggggtaggcagagtcggggcagatgccgatgggactgcgggtagtggcatggcagcgtactgtggcacagagacccgtctgctccgccagcgaccctaccgtcagggcaggatacatgcactcttcggtccccagcaccagcagggcgccctggtccggcagctcctcccggaggcgggacagcagctcttccgcggcggcgcggcagcagtccgtatagcagccgacggccacaccacggcgtgggtccggcagaggctccgccgtgtacagcgtccgcaggtccggcagggggccctgggcagggggagccgcctcctttacagggatcccggtcaccatccgctcatagtcttgatgttccagccgcaccaggcactcacaggcaatgccggcctctgccagcctggcctggttctccggagagacccggctgaggatggacgcagctgccagccgccgctcgcccagccggggataccgctcccgcagctgctggaccatgttgatgagggtccgcccggtggagaactcgtcatccacgaatacgatggcggggctgcggtcgatccagtccgccagctggtcggcacagagccggtgctccgctgcgtggctgtgctcctcccgaaagaggatccaatctccgtccaacgcctcccgggtggtgtggacatagaggcagtccggccccagccgggctgccacggcggcgccgatggcggtggccgtctcggcaaagccgatgaccagccgggcctccgggtacttggcggccacctggtcccccagggcacccatcatctccagagccgccgcggggctcacagggatgtgcttggcctgcaggggattgaccagcaggtagctccgcttggggttgttgtatcgcttggcgatccgcagcgtgtctgcggccgtatatgggtgcattgcggcaccctcccttcgtcgtgtcatgaaatcgtggtgagactttgattatagcacagcttccaccccaaagaaacctctttcccgcgcctcggccatttcaaattgcgccgccggagaatctgtggtaagatgggaaaaacaacaccgccgcggccggcggggaggagcgcgccatgaaaaagctgcaatacaattctccggtgatcctgacctttttcctgctgtccctgggtgtcctgctgctggactggatcaccggaggatggacgaccctgcacgccttctgtgtctaccgctcctccctggcagatccgctgttctatgtgcggctgttcggccatgtgctgggccacgcggatttcgaccatttcctgggcaatatgctgctgcttttggtgatcggcccgccgctggaggagaagtacggtagccggacgctgctggccggcattctactgacggcgggggtctccggcatcctgcaatgcgtgttcttccccggctccgccctgctgggggccagcggcattgtgttcatgctgattatgctggcctccctggcgggcatgaaggacggccgcatccccctgacgctgatcctggcagcggtcctgtatctggggcaggaggtgtacgccatggtggccctgcgggacaacgtggccaacttcatgcatctggtgggcggcgtcaccggcacggtattcggcgtggtgctggcaaaaaggcggtgaagaaaaaagaggcgggcattttggatgcctgcctcttttttcggtttacttccgtcccacgatcaccttgcggaggatgtccacggggatcatggtgaacgccagcagaatggcggcagcccacccggcgggcgggaagggcacacagctgaacatattgctgatccagccgaataccggcacggggatcagggcagcgttgacgatgaacgcctgcaccaggacgatgataacgaacacccgcatgaaaccggggttcagcttcagatccttaaagatgtcaaagctgtcgctgcgcacgttgaaggcgttgaacagggcgctccagatgaacagcacgaaataggcggagagcttctgctccgtgctggcaaagaagctgtcaaagaaaggcactttcaggaagacaaagctcaacgccgtcagccacaggcccatggtgacgatctgggccatcatggacttgctgacaatgctctcatcccggcggcggggcggctcggacatataccgctcctgggcgggctcattgcccagcatgatggcgcccaagccgtccatcaccaggttcacgaacagcaggtgggtgactttcaggggctcctccacgccgaagaagggagcgatagcgctgaccaccacggcggccacattgatgaccagctggaacctgcagaatttcaggatattgtggtaaatggtccggccgtaccagatggcgtccttgatggacttgaagttgtcgtccaggatgacgatcttgccggcctccttggcggcctcggtgccgctgcccatggcgaagcccacgtccgcccgcttcagggccggggagtcgttgacgccgtcgccggtcatgcccaccaccaggttcagctcctggcacaggcgcaccatccgggacttgtccgtgggcagggcgcgggcgatgacccggatgcgggggatgatcttcttcacctcgtcgtcggacagctcgttgagctgggtggaggtcagcgccacatcgtcccgggtccgcagcagcccggcctcccgggcgatggccacggcggtctccagccggtcgccggtaatcatgaccacctggatgccggccttctgcacctcggcgatggcctcccgggcctcgggacgcacgtcgtcccggatgcccaccaggccgatcagcaccgtgtcggcgttgatggcgttctccgtcatctcgctgggggagtagccgaaggccagcacccgcatggacttgcctgccagctcgtcgatcttggcgttcagggactccaggtccaggggatgctcgtccccgtccaggctgaggtacttctgggccacggccaggaacttctccggcgcgcccttgtagaaggtgcggcccgccccggcgatgtaggcctggctgaacttattggcggagttgaagctttgggatttggtgacggcataggaggagacctcatccagcttgtggaaggtctcctgccccagaaagcgcatcagcgcctggtccgtggcgttgccgcccaccacgcggccgctgccgtcatacatggactggctgttcttgccgatggccagatcgatcaggcccttgagcttggtttgctgggccagttgatccagagggatagccacgccgtctgcggtgaagaactccaccacctccaggtggcccttggtaatggtgcccgtcttgtcactgaacaggatgttcagggagccggcggtctcgataccctccgccttgcggaccagcacgttgtggtccagcatcttgctggtgttctgcatcagcaccagagagatcatcaggggcagcccctccggcacggcgcacacgatgatgaccaccgccagggacacagcctccacgatgtcctggatgatgactggggctccggaggagaagtacgccgcaaacccgccggcggagaggatgaagtagccaaagtacatgatggcgataaccacggcgccgatgtagccgaagcgggagatcatgtccgccagcttcccgagcttcaccttcaggggagagtccggctcgtcgtcctgcatctcctcggccatcttgcccatcatggtggcaaggcccaccttgcgcacatccagcacgccctcgccgtcaaacagcacggcgccccggaacagggagtgggcgtccacgaaggtgtcgccggtgatgtcctccggcagggggaaggactcgtccgccgcggtcttggggcattcctccgcctcgccgttgagggcggagttgtccacccttaaagttccgtggatcagcacgccgtccgccggcaccttgtcgccggactggagcaggaccttgtcccccaccaccacgtcatccacgtcgatgacggtgaccagaccgttgcggtagaccttgcactgatcttttttggtgctgtccttcagctggcggtacttcgtgtcgctggccacgccggtcttggcggagacgaatgccacgatcagcacggccacgacagtgccgatgggctcatagatctccgcatagcccagcacacacatgacgatcatcagggccgcaatagccagcaggatccggatcatggggtccttgaacgtctccttgaactccgcccagaaggtggtgggttcggagtcggggatcacattggacccgtatttttttcgggattcctcaacttgtttgtcagtcagtccattaaaatgcatgattgttacacccattcgctgcgggaaggggggcctgcgcacagcagacccctcccgcggttcaaattttcaatatctttttttggggccgccgctcacatatagcgccgggccagctccaccaggccgggatccgtggtggcctggccgatggcgttgaacttccactcgccgttgttgcgatagacctcgccgaagatcatggcggtcatgttgtcgtagttctcggagaggttgtagcggcacatctcctggttgttccgggcgtccacgatgcggatgaacgcgttctggatcatgccgaagtgctggcggcgctgcactgcctgatagatgttcaccaccaggacaatgcggtcatactccgcggggacgcgggccagatccaccacgatctgctcatcgtcgccttcgccggcgccggtcaggttatcgcccatgtgctggacagtgccggtgtagtgcttcagattgccgaagtagacgatgtccttcttgtccgtcagcttgccgttctgcagcacaaaggcagaggcatcgcaatcgatggcggggccagaggacccgaacaggctgccgaacaaaccgcccttggacttggcggcctcatcccagcccagaccgatgatgactttggaaagaccctcgttgcccttggtcaggctgatcttctggcccttttgcagactcacagacatatatatttcctccttcaaaatgtccggccgcgcccccgggcgcggccggagagatctgatgctccctgtcgggatgcttattccacgtccacgccgtagttggcgcacagggccgccagaccgccctgatagccgctgccgatggcgttgaacttccactcgccgttgttcttatagacctcaccgaacaccgctgccgtctcgatggagaagtcctcgcccaggtcatagcggagcatctcctggccgttggtctcatcgaagatgcggatgaaggcgttgttcaccataccgaagttctgccggcggctctccgcctcgtagatggtcacggtgaaggcaatgcgctggatgttgtcgggcaccttcgtcaggtcgatgcggatctgttcatcgtccccggcaccctccccggtcaggttatcgcccagatgctctaccgcgccggaactgtgcttgagattgccgtagaacacgaagtccccggaggaggtcactttgccgctctctcccagcaggaaggccgccgcgtccaaatcaaaatccccgccggtgtcaaagctgttcacgtcccagcccaggcccacgaccaccttggtcaggccgggattccccttggtcaggctgactttctgtcctttttgtaaactgataggcatgatattcctccttgtaatcactcagcgtcaatgccgtagtggccgcacagggctgccagaccgccctggaagccgctgccgatggcattgaatttccactcgccgttgtggcggtacagctcacccaccacgatggccgtctcgatggagaagtcctccgccaggtcgtagcggatcagttccgtgccggtggactggtccacgatgcggatgaaggcattggacacctggccgaagttctggcggcggttctccgcgtcatagatggtgcaggtgaaggcgatccgctcgatgctggcgggcaccttggccagatccaccatgatctgctcgtcatcgccgtcgccttcgccggtcaggttgtcgcccatgtgctccaccgcgccggtgctgtgcttgaggttgccatagaagatgaagtcccgctccgtggggcactttccgctggcgcccagcaggaaggcagccgcgtccaggtcaaaggcgctgccgctgtcaaaggcgttcacgtcccagcccaggcccaccatgatcttggtgaggccggggttgcccttggtcaggtcgactttttgtcccttggaaagattgatcggcatagtgatttcctccgttcccaatatttaatgattcacggaccccttgtccggcatgtgatacatctggtcgaactgggccttgatggcctccagtcgcttttggtcctccacccgctgcttgcgggcgttctcctggatctgcttcgtctcgtcgatgccgctgacgatggtgcgccaggtctgctccagcgtctcgattttaatggagctgccggaggccagacgggcggtcatcttggcctgctccgccgtgttctgggcgttgcggatcagcatttcattggtcttggcgtccagggcgctcatggcctccgcctgcagccgctggcgcttgagcatgatggcctgggtcagcgcctgcttgaacaccggcagggtgatgatgaaggcggagttgatcttccgcaccagattcatattgctgaactgcatggtcttgatcatggggatggactgcatggccacgttctccgccgtccgcaggtcctgagtccgctgctccagcatcatcagggcctgattcagggtggtcagctcgaactggatggagttgtcccctgtggcctccatatccgcctggcgctgggcgatgtatgcctccagctcccggcacccctgctcaccggccaggatgtaacgcaccagctcgtggtagtagttcacattggcctggaacatctcctccagcttccggttggactgcttgatgtctgcctcgtactgcttcagctggacatagatcttgtccacttcatcgcccatggtgtggtacttggcgaggattttgtccagctgcttgcggaggtttccgaacagcttgccgaagaggccggggttctccttgatctcttcgatgtcgaacttgtccatgatcttggccagcgtgttcagcatcgcgctggagtcatccagctgggacaggttcatgctgttgagtaccacgtcggagcacttggagatctcgtctgctgctccggcgccgaaggagacaatggactccaggttgtatacctcgatctggctggccagggcatccacctccggcgagttgaccagcgtctgggtcatcatctgccggtcggcggagatgtcgtactgctgatagctctcttcttcctggggggcggcaggtgcctgtccctgagagggctgaggctgggatggggtcggtctgctgagattcaggcccataagtcatatactccttccaaatagttttctgatggagtgcagtccgctttcctgcacggtgttgaaatcaggaatccgcaggtcgtaaagatagtccccgatctgcgtctcgctggcaaaggggcgcgtgaagtgctgctcgatgcactggtagccggtggggacgaagaatagcacgtcgaagcccactaggctcaaaaacgcggcgaggatgctgtcctccagagagatcctctcctccgtggggttgatgtagatgagcttggggttcttcttggtgaagtcgaacttctggatcttccgcagcaggtccttggggagattcagggcggtggcgatcaccgtgtactccgtaccgttctcaaaggtgccgcggatcagcttctggtccagcagaagctgcaatttgtccagcaggtgctcctgcatctccgcccgcaggatgccgtagagataggcgctgtgggacttgatcttgccgcgcagcagcttgccgttcttcaaaaactgcgtggcgtacggcttcacggggttgggatccgtgccctggacccaggggacagaccggaccacctccgtgtccggcgtgatgagcttcttgatgtccagccagtactgggaggcgttgccgtccttcacgccgcagatcttctggcagatcaccggcagggtgacggtgtccccggcggcggaaaagctgggacggtatttcatctcctggtcccacagaatcgggatctcctcgtacatggtctgcagcaggaccgtggaggccttggcgtactgctggttccgatacagtcccgtgtcctggtacatcagccggtccaggtcccgctccgcctgataggcggcggtggtgacccgggcctggttctggtccaccgggaagcggtccagagagacggattggggacagtggacctccagcagatccggggtgtggagggcgctgccctcattcagattggggagcagcaacaggacatccaccggcaggcgggccagcagccgcaggaacagggctccggtgtccgacgcgcatctgccaaactggagaaagaccgccacctccggcgccttccagtccggaaagaggtccttctgataccggttcagccagcacaggaggtacactgcccggctggtgagcttggagacgctgccgccgcaccgctccccctcctccagcaccagatcgatgaaagctcgggtcatcaggcgctggagctccacattggccggataccggatgttggcggcgagacccgccgccagctgctctgcggaggcgtagttgccccgcttgaccgcggcgatctcctccggcccggggggcgcggggtctccgttgaccacgcagatccggcggccgccgccctggagggactgataaaacgcgaagaggtcgttggtataggtgagattgtcctccacaccgtactggcagaggaagaggttgcagaaaaagcggggatcgtttccgcgggcctgcacagccgtcagcgccgcgttcagctctgccttctgcacccaggcgttggtgcagggagagagggagggcggcgtgccgtagagccgctggcggcgcacctcccgctccagctccgcctgaagctgcttgacaccgaagcccgccgggaagggccccaggccaggggcctgatacaggtgcgacagggccgactgggggtccacggtgagatatgcctggtcgccgccgcactccagcaggacgatatccgcccccgcccgggagaggaccgtcagcagctgcagctcataatggctcacgtccccggcatagaggatcttgggcagcgtctcgccgcccagcacgttgacgatccgctcgaacttgtagtagagccagcacatgtatttcatgtaggcattgcggagcatattgtcgtttttgcccgcccggcgcatatcgtccagggtggcatacatggccgtcaccacagcgtcccgctgcccgtccgtcatccggggcagccattttttcagccgctgggagagaaaatcccggtccatctggaaaccggaccccatcatctcattgaaataggacaggttgtcgggcgtggggttggggatgcgcccgtcgatgatgacgccggaccggcgggccgcctcatagtagcggcgcagaaaagcggccaccgtctccccgtacccggcgatccggcagaaaaacacgcgggacccgccccgttccgagagcgggcggaaataatcattcagttgtgccgttcccgcctgttgaaacatcgcagcccagtctctttctcatcacaagatttgtgtttctcattatagcggctttggagaggattttcaacagatgcatggagcatagcttgagaatccacaaaaattttacattcgtcagcatggcgcgggtattttcttctccggcgggaagtgctataatagcgcccataagtgcccggccgaagccggccgctgatctgaaggtaaaagaggatgagcatgagaagcaagttgactggatatgacgtgggagcactgctctactgccctgccaacgcccacgggtcgattgtgggcgcgattgtggagcagcggtttccaacgccgtattctctggcgttctgcctggaggacacggtgcgggaggacgccgtggcggacgcggagcggatgctgcgggggacgctgtcccggatcgcgtccgctgcggagggcggctccttttttctgccgcccatttttgtccgggtccggtcaccggagcagctgctgcggctggcggaggagtacgccccgttttcctccattctccgtggattcatcctgcccaagtttttcctggagaactgcggggcctatcttgcagccatccgctccatcggccggacggaggagtacttctatatgccggtgtttgagtctgcggccatgattcccccgcagactcgccgggaggctctgacggaggtgcgggcccagctggacaccgtgtctggctctattttaaacatccgggtgggggggaacgacctctcccacgccttcggcctgcgccgtccggcaaatcggaccatctacgacctgcgcccggtggcggatatcctcatcgacatcgtggcggctttcggcactcaatacgtggtgtccggcccggtatgggagtattactccggcgagggatgggaagaggggctgcgccgggagatggagctggatctgctgaatggcttcaccggcaagaccgtcatccatcccaatcagatccccgtggtgaacgaaatgctccgcgtttcccgtcaggattacgcggacgcccgggctatcctgaactgggataccggcagcggcagtctggtctctgccagtgaggacggcggccggatgaacgagtacaacacccatagccgctgggcccggcggatcctcctgcgtgcggagcggtacggcgtcagggcgtgagaaaaaggacttgaatttcgctccgacctcctgtataataaaccagtatccaccggccagtgtgatggaattggtagacgtgacggactcaaaatccgttggtggcgacaccgtgtgggttcgagtcccaccactggcaccagttgaaaatactcaggtttttcatgaattgaaaacctgagtattttctttttgaagcccggttctctcctggagttctctcctccggcttgaatcgcggctgagatgccaggggtgatgctgactgtctggttcattttcgttgcaggctgtttcttggaatccgtgtccaggtgcgcgtagatattggcggttgtagcgtagctgctgagtcccagccaatcctgaatatccttcaccgcgactccgtttttcagaagcagggatgcgcacgtatatctgaaatcgtggaaacgaatcggacgaaggccgtgctgcttcaggacccgtttgaaatggtcggacacaaaattaggcttatatgggatacccagctcgttgacatagatgtactccgactccgtgtagcagtttccgcagaactctttacaagtggctttccgttcctgcatccgcagcagaagttcccggtactggggaaccggcggcatcgttctgcagctggatttgtttttcatccggttcttgccttcgatcacactcttgccatcggaacgatactggaccacggtatgatcgaccgtgagaatatttccctcaaagtcgattgcgctccaccgcagtcccataaccccacttctacgcaggccgtagaacgcagccatcaggaccggaaattctaccggatctccttacataaaatgtccatcaaaaatgaccaaataaataaaatggttgtcttaatgcatgtgtattcgctccatacggagccggcctgtaaaagtaagtatgcgctcgtgttacatttttgtttctcccaaaagggaaaaccgttcacatcttcaaatggatcatttgatagaaaagtcacacgggtgtggaggaattcgtatgcctaagatattttcagattgagcattttcccttttctgaaaaagagcaggcccataaccaccatgtagccctccttgagcaccataagaccaaacaggacccacatctggggatagcggaaggccagacaaagagccaatgcaccgtgtgtcagtttgtccgcgatcgggtcaagcgccttgcccaaatttgtgatcatgttgaactttcttgcgatcatcccatcaaacagatccgtgagactggagaggaggacaacacctgcggcccaatggtacgcttcttttgccagatagaggtaacagaataccggaatgaggaggagccgaaaatatcccatcaggttcggaatagagaatctctcttttgtgttgaatggcttcattgaggttcttctccatctcctatatgcagacaagtcatgcggaagcagaagactggaaaaattgcgacaacgcgtttacagcttcggcttcgtcagggccgtctgcagcgacctgtacctgctgtccctgacgaaagccgaaggagacgaccccgagaagacttttcgcattgatgcttcgctcaccggcgattatgcggatggtgctctgaaagacattgacatggcttacaaacagtgcggctgtatgtgtggtgaaatcttcctccaactgcaatgaaagggtccgcgttgtcatgggaatcgtcctcccaatgatagattttcatttataaatgctcgatccaggggcttcggaacatgtgcgcttatgatgcgcgatatttgcgctctcctttgcacagccagccctttcttctccaacttcgaaattcccagcgggccagcagcaggcagagcaggaacgcaagagcatcggctatcggtgcggccagaagtgcgccgtctagcccgaaggagcgggatagcagaagcgccagagggatcaggaagcagccctgccgggccagaggaatcagcagggacttaccaggccggccgatcccctggaagaaggaggctgaggtcatgtgaaggccatacaggaaaaaggccagcatatagagccggaagcagtgctgtgcgcaatccagatagagcgcattgtccgatacaaagcagcttgcgatctgccgcgggaacaccatgaaaatgagaaaccacaccactgaaatgcctactgcaataagagaagctatatggaatgtcttttggacccgcgcatagtggttggcgccgaaattatagccgttgatgggctggatggcagaggacaccccgacgaacatggagtgagcgatctggtagaccttcatcatcatgccgtagacggataaggcaatgtcactgccatagactgtggcggctccataggcccgcatcagattgttcagggtaatctgcaccagagcggagagcatctgcgtaagcaagctggggaggcccagtgccagaatacgacaggtcagcttccgtgtagggcgcaggtcctcccgccggatatgaacggttttgaggcggcgcaggtagagcagggccaggcatccagcagccacctgcccgatcaccgtggcgatcccggcgcccacaacgcccatcttcagcggaaagataaagatagggtccaggatcagattgatgaccgcccctgtcatcatgcacttcatcatgtactgcggggagccgtctgcccggataatggcggtgaaggcgggacaaaggagctggaacgggatcccccatgcgatggcgcgcatataggacagagactctgcataggcagtcgacgtcgcgccgaaaaggactacgatctgcggggcgaagatgccgcaggccagagcggccagcagaccgctggccaagatcagggtgagggcgtgactgatggtgctgtccgcctcccgctgctctttccgacccaggcacagactgatattggcggcacatccgtctcccagcatcaatgccacagcattgaccagaatggtcagcgggaacgcgatattagtggctgccattcctgtaatgcccacgccctgtccgacaaagatctgatccacgatgttatagaggtagttgaccatcagtgtcagtgaggtgggaacggcgtatcgaacgatcagtttgggtatgggatccgtttccaatgggtttggctgcaggtttggctccatagcaaggctccttccgtattcatactggacgcttccgagggagaagccgccggaaataaaaaatcccggcgccatttccctgacgcagagagatggctgtaccgggtgcttagagtatacacttttgcttgaggaggatgggcatccggcacggcaccagaaagccttcttctcccctccagaccgaacctgttggctccggaattccaccggattagctgatcgctcgcggactgttaccgccagtagagaaatatctcgtttccgaagaaaacttacatacctaaatgtatcattaaataaaagaaccgtcaaggaaaatgtccttcccgccgtatcaacttctgcgctttctgatcgatatcctgtgtctcgtacaaggcattccattttggcttttcctgtggtaaaatatcaaaatcgacaaaatcacaggaggcaggacagggatgaaaacgggcttggtcttggagggcggcgccatgcgcggaatgtttaccgcaggcgttctggactcctggatggatgaacagatatcctttgatggaatcgtcggtgtgtcggccggtgcgctgtttgggatcaatgctcccgccggtcagaagggacgcgccatacggtataatttgaagtatatccgggataagcggtacatggggctgcgctcgctgctgaccacgggcaatctgatcaacgccgacttcgccttctatgaggtgtcctccaagctggatatatttgatgaagcggcctttcagagatcgggcgttgacttctatgccgcggtcaccgatctgcacacaggcgccccggagtatatccggatcacagagccgttccgtcagatggaggtcctgcgggccacctctgccatgccctatgtctcccggcctgtggagttggatgggagattctacctggatggcggggtcagcgacagtattccagtccatttctgcaagagtctgggctacgacaagaccgttctcgtgctcacacgtcccttggagtatcggaaagagcggcccgcagcatggcttcagcgattcaaccgcctctattaccatcgctatccggcctttgcggagagtctgaaccggcggtgggaagtctataaccggcaggtggaggagatcatagggatggagcagcgcggggagctcttcgtggttcggcccaatggcccactcccaatcaggcgtgtggaaaaggaccccgccaagctgcaggctgtttatgacctcggggcagaggccggcagggcgtctctcagcggactgaaagagtatttgctgacgcatgaatgatggtagatgatataggaaattgcgcatccagcaggcaggggcttgtatggatgcgcagtttttctttgtgcagtatacagcgtcccttggtccaggtatcatgattggcaaaactggcgggatggcatatatactttttgaataaagaatttctgatacatatcggacaaattgacatttttttcaagtaacattataatgttcatatattcactgccacaagaggacgtggttagaaggggtgaagaatatggatcaggatctgcccttatgggtagagggctgcgccgaaacatatataatgtgggtgtgaatggaagcagacagctgctgaagatcttgccggacaaaggtatgcaggtgcggccctctggagcaaacaaagaaaaggagggcatttttgatggatcacagcgtattgacgattttggatctgggaatcattacggcataccttgtcatcatggtcctggtgggggtctattccgtcaggcggatccagaacacaaaggattattatgtagcgggccggtcctttgggccgatggtgctgatggccaccgtctgcgcgacgatcatcggcggcagcggtctgatgggccgggcaggtgtggcctataccgacggcttcaaggcggtccttaccgcaattccataccttctgggaatgttcattttctccggcatcgccgggaagatctcggatatcgggatgcagtacgggatcacctctatcccggagctgtttgaacggcggtttggccgggcagccaagatcaccctctctgtgctgatcgcgttcgccatgatggggacggtggcctcccaggtcaccgccacggccacgatcatccggatgctggggggagagttcggcctctcctatgagatgggcgcgctgatcgcaacagtggtctttatggtctacacagccacctccggcctgttcggcgtggtatacaccgacgtgctgcaattttatatgctgatcgtcttcgtgtatatcctgatcccggtggcggccctgttcaacgtgggcggctttgcgaactttgcggccaacctggacccggcgctggtggagccgcatattgacggcagcattttgggagacatcatcacctatctggttttcaccatggcaggtgcggaaatgtggcagcgcgcatttgccgccaagagccgaagggcggcaaagcgcgggatgttcctgggtacggccgtatacggcgtgaccattgtgctggtctacttcatgggtgttgtgggccgtcagatcctcggcggcgacatcctggcgcagtatggctcgacggacgctgtcgttccggccctggcgatccggatccttcccgccggtctgacgggacttgcgttggccggtatgctctcggtcatcatgtccacggcggacagctatctgctggtatctgtgcagacctgcgtccacgacatcggaaagaccatccgtccccaaatgccggagcggaccgagatctccctctcccgcatcttctccattgtcctgcccctgggcgcgctggtgatcgcgttgtacatccacaatgcatacaacatcctcatgttcgcctggagcttctatgccgcatcggctgggattcccgcatttgcagcgctgttctggaagaaggcaaccaagaccggcgtcatggccgggttgctgggcgggtttgttgtctgcgttggctggaagctggcaggccagcccttcggccttggggcggcggtgccgggcacggttgcctgcggtatcgcactggtcgttgtgagccttgcgacttataagcgcgcaccgtccgtattcctgaaagctgaaaagcagagctgatagggagctgctgcatccccatatcggaaagcaatggagtgaacattataagagccagccggaaattttgaagatccccggctggctttgttttggcgtattactgatagataaaaagtctccgatcagacagcagacctcgccactgctgtctttgccccaataccaatggcacacaccgctttttcagatcgcgtcaccaatgcggcggtcagcgctccgtcctcagagcttccgacagcgtatggcagttcttcatcttctgcatcccaaaatcctgtcctgcacgcatcaactacatggcgggacggtggcctgcgcttgtgcgcctggccatggaccatctttgcaacaacaaaggttactggatttctgctgcggaaccggatgatggcaaaggctgagaagtgatcctgatttgtccggagcacagcttcagcagaccgatatcctgccgtgtgacgcgacatatcccatgcggatttgtcagcagagcgacatctgccttctcgccattccaagccattctcagaaaggaaactaatatcgttcagaaaggcgaattgcaggaagaagtcattgcaaaaatacaacaagcacgccctgcggagcgatggggagaaagaccaaaacaagggaggcacgcttttacaacccgtatccgtcattgcgggccgcccaccgcgcgggacttctatacaccatggtataaaacagttctgcgggcttttacgccgtcacagggcacagccgggcagagatcatttgtgccagtgcggaccgcagcaagaccaatggacctgatcgcctggaaacgcgtgctggatgggcgtacgatgagcgggtattccaactgcattgagtatctgatcgagcgccagagcaccttcgccatgtggaaatttgccgcctgtgtcagtgagcttctggttttccgccgataggatattttgggataagggcgcgcccccagacaagcggccgtcgtcaaggcagacaaggagcatgatgcgttcaacaagacccggaaaatggtctccgactctaacaaggaagtgctcagaatactggagtcaggagatggaaaataacttcattatataattggctttttcgtgatcttatggtatgatacccttacgctgtccagagcataatttctagaatgaatccccctctgtaatgtgagtgaatcaccgcaaagtggtactgttcggcgccgatgggcgctatctttttgtctgggcggatgtagaagcacggatgaagaagaattacaatatgcattgtatgccgatggttgtgctgttgaacctcggagaggatgcgctggttgtccgccgccaaggatatgaaggcgtgccgcaaaatacgggcctgcctgaatggctgacggacggagaaagggggcaaagtgatgcgcacactgattaaacacggactgattgtagacccggccagtcatgttcactccaaaaataatctgctagtggaagacgggcgtattcaggggctgactgctgaagagccggaagctgatgtgattttggatgccgaagggatggtggtttcacctggttttgtggatatccacatgcacgaggatccttatgacccagaggaggggcgactgattcccagcattatgacctccatgcttcgcatgggagtcactacagcgattggtggaaactgcggtatcaatacggtctcgcctctgcggtatttagaattgatggaccgtgatggcggcccgatcaatatgggactactagctggccataccttcctgcgggagcaggccgggcaccgggacaagtacagtgcaattcggcccgatgaacaacaacggttgtcaaggctggtcaaagaggctctggaagcaggttgctttggggtgtccttcggtattcgctatgtacccggtgtgacacgggatgagatggtgaaaaccgcctgcttctgccaaagccatggccgtcttgtggccgcccatgtgcgagatgacgcggataatgtattcggcgcggtggaggagttggtttccatagggcggcagctggatcttccggttcaagtttcccatgtgggaagcatgggggatttgggcagatggaacgactgctggccctcatagatagatatcgcgcctccggtatggaactgagcggagattgctatccgtatgacgctttcagcacgcgaataggggaaacaacctacgatgagggatttttggagcgttactgcacacagtattctgcgatagaaatctgcgagggtatgtacaagggacaacgatgcacggagagattgtttcatgaactgcgtcagacagcaccggacacattgacggtctgccatgttatgaaggcggaggatgtagctttggccctgtctcatccggccattatgctggccagtgatgggctgatggatcgggggcaaggacacccgagaggtgcaggggcgtttccacgcctgctgtgccggtatgttgcagccgggaagatgaacttggatgatgcggtcgccaagatgagtgccatgccggcccaaaaactggggctgacgagaaaggggaccttacgcaagggcgcagatgcagacatcgtaatttttgatatggatcggatccgggactgtgctacgtttgagcatcccgaccgtcctccggaagggatagaatgggtcttgattgggggaaaaatcgctgtggaacacggaacagtcaagcagtcaagtctaggacgagccattcgcgcttagcaatggagcaggagggagagacggcatggacgaatatgtgaagcggcagctttcctcagttccggggcatatcggattttactacaaaaacctagtcacgggagaaacggacggaagccgccaaacggagttgttccaagcggccagcgtaattaaactgccaattttggcggccatcctgctggaggagcgggagcatcccggtgtgctgcaggagcggctcttggtccgggacggcgacaaagtgcccggatgcggcgcattgcagcatatctccggtacgcaggcgtatgacatagaaagcctctgtaagctgatgattactatcagtgacaatacggctacgaatgtgttaatccgccgctttggcattgagttcctgaatgagcgattccgggtgctcggccttcaggaaaccaagatttttcgctttctgtttgacacggaggccgcacgtcagggaaaggagaatttatgtcaaccgaaggagatcggtagccttctggaggaaatctaccacggacgctgcgtgagtgccaatgcgtctgagcgaatgcgggcgatgctatcgcaacagcagattaaccataaaatccccagcctgcttccgcccaccgtgcgggtggagcacaagaccggcgaggatgaggggattacgaatgatgtggggattctatatgggagagaaccctgtgttctggtattggtatccaatgaaactgatgtaccggcctttgagcaggtaatccggacagtgagcctgcactatacacgagtgtgatgacagacatatagaaaaaggagaaaacttgttatggccattattaagacgatctcggaccttctgtggggaatgcctctcatcgtacttattctgttggctggcattatctttacggtcggctccaaattctttcaaatcgcacacttaaagcatattctgaaaaacaccattggaacacttttttcaaaaaaggacaacggtaagggcatgatgaaacccttggaagtaatcagcattgccgttggcggagcagtgggtgttggcaatatcggcggcgtagcgaccgctatcgcggtgggcggaccgggtgcagccttttggatttgggttgcggcctttttgggcatgatgatgaaaatggccgaagtttccctggcggtatactaccgttcaaaggatgaaaagggcggctattatggtgggcctacatactatatggagaaagggttgggacgggataagggcttcaaattctggggcgtgctggcggttatcttcgggatcggcatttttggaaatgtcttttccatgcaaaacttcacggtcgcacagtccgtcaacgccacttttggcattcccatgctggcggtaggtttagtctatgttggtctcacctatttggctactgtccgtgaaattccttggctgggcaagctggcggcgaaagtagttccccccatgtgcgtcttttacctggtaggcggaatcgtgattatcatagtaaatatcacacaattgcccgcagcacttggactgattatcagcgatgcatttaccgggaccgcagccaccggcgctttcatgggagcgggcgtggctttgattatccgaaccggcttatcccgcgccatgttctccagcgaggctggctggggtacatcgcctatgattcacgcctccgccaaaacggagcatccggtgaagcagggattgtggggggcatttgaggtttttgtcggtacgatgtgtatctgcacggttacctccttggttatcgtcgttaccggcctgtgggattccggcctggatggtgctccattgaccttggcggctttcgaaacagtgcttgggcctgttggaactatcatcatcacggtggccattttcctctttgctctttctactactaccggatggtgggcttatttcgaagtgctgttgcgccatttgtgcggcacgaatgaaaagctcaagcggaccttgattaacgtatttaaggtaatctaccccattcccgggttccttgtagtgcttctggctgcggtgggaaacgatatttctggtgcggatatttgggaaatcgccaatttgacaacgggaatacctgcctttgtaaacctgattgtcattgtcatactgagcggaaagttcttccaattgcttaaggactacaaggctcgttatctgggaatcggtaccgttgatccgaacttcagactttttgatgaagaggaataaaccgagcctgaaaatggcggattgagaagccaagaggggggcgtggctctgccacgccctccagcggcggaaaatatcaggacagcgcatccaacaccacatcgaacagatgcatagggttaagctgccctctgtcataacgctggcaagtgaatcaacgaagtccctgtcgcaggaaacggctggaatcaatgtcacatcggtacagactccatccatcacttcggcctgtattccataagacggaagtcagctggactgcaatggtacagatcggccatgcggcacacgatgccaaatggaggggcagaagtccctgcctcatacaacaagtgtacgtgctttgctgcggccgcttgggtgtatccggctttctcccggcttgctcgaacggattttcaggatgaccacctttttcggttctgcacattttgaattcctcctgtcatttttctaatacatttgggccgcgctccccggaaatccttgtgttttcaaggtttccggggatattttcttggccatttcccttgcttttttccttacgagatgtctgtaagggaaagctctcagctttcacccgcacccttatccagaaaccgggcggaagaacctgtggttcctttctttgcatgggcgtagatgttcatggtggtgttcacgctggaaaggcccagcagctctcggacatctttaaagacgctccgccataaattatgttgcttgtgaaggtgtggcgaaggacatgaaagtgaagggcctggatattatcgaatgtgatgttggctcgtctgcacgccgtagctgcccccagagcgtacaaatgtcccatcattccacaggcagacgaatgagaactctgtaaagcattcccgtggttcatctgtgcggggcagggaagagagcccgtaatatgtacggctcgttttcttcggagatcctgtgtcagctcctgatactgccgttaaagcgcgccaaatccatataatactatttgggaatgagtttgtttgtgcagcaataacagggcctactgcttaagtcaaaattgcaaaaaaagacatgcaaaatttgggaatgattccaaaatagtgtggtttgtcaaaaaaagtgttgactttttttgatggcggctttatgttaaaaacatgttaagaaaagaggacgcggcgatactggttgtttatttttcacaatagagtgccagtgtttttttgaccttaaaaatgagaacgttttcaagagggcgtgggatacatacatggcagcaacaatcattgacgtcgcacggttatgtggttactcaaaggcaacagtttccagagcatatgcgtctccggaagcagtcagtgagaaggcgcgtgaaaagatatatgcggcagcgaagcagttgaactatgcgcctaatgccatcgcaagggcgatggttcggcaacagacagaaaatattgcatttattatccacgaaaagcagtatcccgctattttgaatcctttttattctccgatgctggaagcagccatgcaggagggaacccgaaggaattacagcctgttcgtaacgaccagtcaggatatccacctgcccaatggagatatttatatcaaaaagcacatggatggagtgatttttgctggcgaggttgatatccgggtcattgaagagtttcgtaaacagagcattccggtagtgttggtaaacaactatttggatatggatggcttagtgtgcatttcggcagatcactatggcggtgctgtgcaggctacggaatatctttgcaagctgggacattgtaaaatcggcctgttgtccggccggttttcaccacaagttagtgaagctcgtatagagggcttcgttaaaactcttgctaagtatgatattcccgttgatgatcgttttattgctgatattgagccggcgctggaagatggcgaggaaatcatgacccggatgctgcggggggtggatcgccccacagcttttttctgcaccaatgacaccattgccgcaggcgccatgaaggcagttacccgggcagggctgagagtgccggaagatatagcgatcatagggtttgatgacagctatatcagccgtgtggtggaacccgagttgaccactgttcgaattgatgctgctaagatgggatgccttgccatgcaaacgttatttgacttaattgcggggatgccggtagaaaaggcgcatattcaaattcctacggagcttatagtgcggggaaccgcttgatgctatgtagaaatttgacacgctcctgatagagcgttttaaatggtgaagtcaaagtgcggaaggatgtgatgccatgtgtgttacagtcatcaatgtcggttacggagacgcaatcctctttcagttaaagaatgggtatactgcactgctggatggaggaagtgccctggagtcagaatttgaaggcgattcttatcgcattcggtcagcagattatcttgccagacagcagattgagcatttgaatgctgtgattatttcgcatatccatgaagatcatgtatgcgggctggaggcggtattacagcagacagtggtagatcatctctatgttccgtacccggtagagcctttcttaaaaggctgtgaactgactccagccagtaacgctccccgcagtgtaccgctatatgttgcggccttgaatgcgtatcggaggattttgcttcatgcgaaggaaaaaggcattcctgttaccgtgttgaaagcaggacaggtactgaaatttggaatagacacgaagatgcggatactggcacccaaaagctgtgttgtagatgcatatatggagatcgtggaacgggcatacagtcttgaggcggatacaaatgccgtgactgagtgcctgatccggttggacgctacatccaatcacaccagtatgctgttgcgcttcgaactgggagacatcgtttttctcagcgcggcggatagctgtccatctgaatgggatgaggtgcctgaaatttttttcaaaaatgtaaacgttctcaaattgccacatcatggacaaatagattcaatttcggaatcttttatgaaaaatatgccgttggagtatattattacgacctcggcatctgatagacggtatcatagcgcgaatcaggcggtatatcagaagctggccgcaatctttccggcggagcatccaccacactttttgttttcggatgagcgagagtatccgccttatttctcacagcccgaaggctttcaggctatcaaacttgtaatggattccgggatggttataccggagtttattagaattcaatgaaaagaggagagaaaacaatgaaaaaactcatgtcgctggtcctcgcactcgctatgattctgagtttggctgcctgcggcggcaaaaccacgggaacgtcacctgacagcgcaggcgattcccagcaggaaactcccgcgacttcggacggcgctttccctgaaaagcagatcactattattatgccctggagccttggcggcggacccgataccattgcccgccaggttgcctcctatggtgagaagtatctgggtgtgcccgtgattgtggaaaaccataccggtggttccggaactatcgccatgaacgatgcattgcaggcggaggatgacggttataccatggtggttgccaacggccccttgttctcactgactcccagcttcattaatgtcaactacacactggatgatattacgcctctgattggtatgcgtatcacggagttcgttgttctgactaactctaagagcggcatcaccaatatcgacgagctgaaagcctatgccgcagaggggaacacaatcaagtacgctaccacaggcggccctggcaacgacagctatactatgatttccgtcctgttcaagttattggacatccccgctgagcctgttccctacgacggcggccaggaggccatcaatgcgttggtgggcggccatgttgacgtggctatcggttctcccccgacttaccgcgattatgtgatcaacggcgaattgaactgcctgggaaccttcattcccgaggggctggaggtggaaggcattggccacatcagttcctttagggatcagggagtcgacgtggacttcaccggcatggactactttgcggtccgctcctctgtggatgacagcaagaaggaagttttgaccaacttcatcgcggaggtttatgctgatcccgagttccaggaatttatgaaaggcatgggcatggaagcctgggaggccactgagagcgagatcgttgatatggtagaagctcagaccgaggcgatgaccgagtatattcctctggtgcagtgacactctgcggtgccccatatcgccgagatatggggcacccattttaaaaagaggtattgaattatgaaaatcagatataacagagaaataatatcgggcgctatttttgtggttctgagcgcagtgctgtggttcctgattcccgtacaggtccagacgctggagaaaacgccaatcaacgcacagaccttcccccgtatcgccattggtggtatgttcctctgctctgtcggtctgctgctggaggggatcttcgtccgggagaagcaggagttgtatgtgacgaaagagagttttcgctccaatgcctttaaaaaagaaatgcgttccgtagtgttcgcattgcttttgatcgcctactgtttcctgattggacatctgggctatattgtctccacaatcctgctggtactggcggtcatgatgttctataaagccagaaagtggtactactatgcgattcctctggggatggtgggcatcgtgtactacgtattcaaggtgcttcttcatatttccctgccctgatcgaaaaggagaatacttatggaacaatttttaggcggactgcaagttctgctgcagtggcagaactttttgattattccggtggggctggcaatcggtattattgtgggtgctatccccggactgacctccgatttaggtctcatcctttgtatacccttgacctatggcatggatcccacgatggctattttaatgctgctggccatctactgcggcggtacctacggcggttccatcactgcgattctcatcaacaccccgggtacctcggccaatgcggcaacgctgtttgacggttatcccatgacccaaagaggacaagcgttcaaggcactgcaaatggcactgtacgcatcaaccatcggtggccttataagcgcatttgccctactgtttctggctccccagatcgcaaaaatcacactgctgtttggccctgccgaatattttgctttggcagtttttggactatccgtgattgcgggcgtctctaacaacagtattttcaagggactgatcggcgcttgcatcggcttgttcatggctaccatcggcatggacaatatcagcggcaccgcccgctttacctttggaagcaatcggctcatgagtggtatcgacctgatcatcgccctcattggactgtttgctatctctgagattatgatgaagtcccagtatgatccaaggaccgaccacaagactatcagttcttcagccatcaccagagataaaatcacgaaggacgagtatcggcgatgccgcaaaccaatcggcattggctccctgatcggtgtcattatcggcgcaacccctggaactggcggtggtttggcggcgttcatctcttataaccaggtgaagcaatcctccagccatcccgagacttttggccacggcgagatcgagggtgtggccgcctccgagtccgccaacaatggcgcctgcggcgcaacgatgatccccatgctgacgctgggggtcccaggggacggcgccaccgctatcttgatgggtgcattcatgatccacggcatgatccccggccccacgctgttcgaagagcagggcaatattctatatgccattatgctgggcctgatcgtggtcaatgtgtttatgtatattctgggcagtggctttacccgtttttacgcgcatatcacccgtattccctacgagattttggcggctattgtattgaccttttgcattgcgggtgcgtattccaccaataaccggatgtatgatatctacatcatcctgatcttcggcattgtagcgtatttcctgcgccggatggattttcagttggttcccattctgctcggcattgtgctggggcctttggccgagaaaaacttccgccgggcactggtgctgtctgacgggagtctggacattttctttacccgtcctatcagctgtgcctttatcttgattgctgtaggttctattttgctgtttgcctggaaaaatcacaaggcaaaggtaaaaaccacacagaaataatacagatctgcgcaagtactgagacatctccttatttgagcattgccaaattcatacaatttgaagagcgacggtgtttgagatgaagaaaattttgaaaaggcttttctgcttggctatcgctgttgtgatgttaatgagtactgcgggggcagaaggaacctccacttatatggcttaccggtcaaatgccgttacaatatcagcagctgacggacttggcatcgtaagtggaacattcgtaataaaggatctcagtattacaaacgggcaagatcctgatggtcgcaactatgttggacaggtgcatacacttgaaaatggggaatttacattcagcgttgggcgcagtgcctctgaaagcgttgcatcatggttcaattcaaagatctcaggatataatgatccttctgtgaacggagatagaacaacatttgaccagactgctgatgatttgaattttgcctttgtcggtgatttgaatttggttgtggatactgccgatgatccgcagggtctaagtgttacatttcctgatgttgttattgctcaggggagcaccttgtttagaaataattggtggtttggtcaacgctctggccagcatacaagagatagtgacggccccgacactgtattggcaattggaagtacgacagagggaagaacagtttatgcatcgtttttgagaggcggcaacgaggttaatgagatttctctggaagccattcacgtggtagaagctgctgcggatagtgcgaataaagttgtcgatgttaaaaataaatttgctgcgcttccgattgatggtgttcaaagcaatttggaaggtttccccggcagctatgaccctaccgtaaatcatatccagggatatgcgcagtatgatagttgcgatcatactcgatattctattctgacgcatagtgtaggaactgcgccctatgcgcatattgtcgccggccccaaaacgggcagtgacaagtgggggttcaaaacataccttcagaattggagacatcctggtggcgttcaagtaatgggagattatctgttggttccctctgaacaagatgcttccgcgcatatagctttatatgatttgcgttcattggccgtaaaagaactaagaagagttgagacatttgacttagctgtaagccataaggctggtgctttggggattacttcttatgaggataaaaacggcattgagtattacgtgatgatagttgcccatttagatggcgagaatactgtgtaccatgtctatcgtgcattggcatcaaatggcattgaaaacgcccggttctccgaagttggaagttttgaatctgataaggactttcaaggttttggcttgattactgaggatgggacaaatgatatttatatgatagggctttggtcgccaagcgagggtgtgacatttgcggattatgcatacctgtaccagttgaatacggaaacatggaccattggagaagcacttcagcagattcacatggtcagtgttggaggaatggctggtatgatgggagttcatttccgttatggcgcaaatgtatatgttgcagacgatggtacgctaactttatccgctacagagcggaactcggttttgggcagctctttggcaacaaatgattggattcctgcaatcgtaaactaatatttgacgatatcgttatgtgaggaaagggaacgggctgtgatccgttccctttctccacagtgaatattctattgataaaccgcatgatggtggatatcttgttttgactgacaatgaataaaccaaagctgacccgtagtgcatagctgggggagaactacggcgaattggctcaaagacatcttcttcggttttttaagcagttgcgctaaagcttgcatgaagcaatctttcctgttcctttatgtaaatgcatggcgtcgagaaggtgtcatctcccccataaaacagactgcatttcgcaagagccgattggaacgtctcctgaccggcacgctggcagatcttctgtttattctcttaaaagatttctgctgtgatttgcttttcggctctgccgggcggggctttagaagtttttggctttccggccctttagagtgagcagcaaacaagaaaccgtcaagcctcttttgatgcttggcggtttcctgtttgacgcttatattgctataacaaatttcagggaggtgtcacgaattttgagaacttcaatcaagcgggaatgagtcgcttttcgagtttagaagtgatccgccatgtcctcacccgaaaacatcttaaagggaatccgagtttttaggatctgatcggctgcaatttacagcataccggccatcacaccggccaccaaaatagagaccattgcggccataccgcccactaccaggcgaggcatgacccggctcatcagaaaggccttttcatcctcatcctccgccacagcattgcatacctccacagagattaggtaagtggaggggaaccccagcatctgacagaagcctacgccgaaggccatggacttatcccccagaatcttccacaccggcaggactttcatcataacaaagatggaaagtaccgacaccgcgaacacaaccaccagcgggaggatcaggtcgatgaggtcggatatggagatgttggccagggcgggaatgatggcagcgaacaccaccatgttgataaaaccgctggcttgggctttctggaggaggttcttgggcaccacacccagctgggtgaagatcacgcccaacaccagccccaggatggcgtagttgatgtgggtcagctcacccagccatacagagagcaggccgccgactactgccagcaaaatgcacacattgctggaataaaagccgtcaaatttctcggccaatgttatcctcttggacgctgtctttgcctcgctgttccgattctcggatttgcccgcggcggccataaactcgtccagggtgccgctggatttggccttccggtattcgccgatcaggccctgggcatagcggagactggcgctggaggcaaagggcgtacccacgaacttctgcacggcgaaggtaatggcagccagcgcggcggccagaggatagccagccttggtggcagcctccgtcatgatctgcgttgcgggcagagcgccgttgactaccgggatggcgctgagggccatctccttgccgatgatagggatggtcagtgagacgccgatgattaccgccagcataccgaaccagcaagtgaccacagtccgccactcatccatgaactggcgcaggttaatcatggaccccatagcgaagagcagcattggcacgctccagctggaagcggcgctgagaccggccttttcgatgatgtcggcgggcaatacgccggcgacgaacaggaccaggaacagcatcagcgtggcgaacaccgaggagatccgggctttggtcagcttggccactacgtcgccgacagcgaagagaaccatcaccactgcgaaccacagcaacatatcaaacacttgtcattcatcctttctctatctgtttattgaaagggccgcccggcgcagccttttagagatactggtcgaaccagtcgcacagagcgttgagccggatcagacggttgaccggccgcccggaccggttgagctcgtggccctcctgatgaatcaggaccaccttggaaggaacaccctgctgacgcagactggtgaacatctgcaggggctcgtccatccagcagcggtagtcggtgttggagtggataaacagggtgggagtggtgacattgcggacgtacttcaggggagacttgtcccagaggatctggctctcgtcccagatgacgcctttccgctccagggcattgaggcccatgtgctccagcaggaacagataccccttgtcacaggtggagatggaggtgacaaagttggaaatgctccgcatggcacaggcagccttgaaccgctgggtgtggccgatgatccagttggtcatgtagccgccataggacccgccgcacacgcccaaccgatccgcgtccacgtccggataacggcgaagcacctcatcggtgaagtccatcagatcctggtaatcgatggtgccccaccgacctaccagatcgaagtaatcctgccccgaccgtcgctgccgtggggatttgtatagaacacgaaccgaccgccagcggccagcagctgcatctcatggtagtactgggaaccgtaggccgccttggggccgccgtgaatgttcaatacgccgggatacttcttccccggctcgtatccggaggggcggatgacccagccatccacctcctgaccgtcccggctgcggaacgtgatgtgctccggacgtgagatctggcgggtctccagaaaggcgtcgtggaattgggtgagcctctccggttccccgccggagaggggctggcggtacagctcctgaggccggtgatcccggaaagctgccagataggcgttctctccaatgatatcaaagcaggcaatcccctcataggaggccacaggagcaaagttccccgccttgtcgaagcgcagcagggcggtgacgtcgcgctggagacggacggcatagagactgtctccctggacggcacagaccttgccgccgcccaaagacatatccccgatggcggaggtacccaaaaaaccgtccggggcgcagaaggtccggcagtccccggtggccggattcagcagatagagcttggggcttcgggagacgctggtgtgtgggtcgccgccctcgaaccagatatccgtgccccaccagcccacctgggtgatccgatatttcctatcggggaccagtgaccgggtttggccggtggccagatcgtagagcatcagctgccggtagtcaggccggattccctcaaagctcacaccccaatagaggatccgagagccttccggagagactgccgctccttccatgtcataggtgggaggggtgatctggtttacggagccgtcggcaggatcgaaaatccatccgctcatccgggtgccgttaatcatccccagaccgtcggcccagaagggcagttcgtcaaaaaccgtatagtcacggccgggctgaggctggtccgcaggcaggtcctccggaggggtcatgggccgccgggtcaggacgaaccatcttccgtcgggcagggggtgaaactgctttaccgacaggggaatggtgaaagcccgttctgcttcgcttccccggatgtccagccggtaaaaggcggttttaccaggctgatccccggtccggcaggaggggaagatcagcgtatttgaatccagccagcgaaaagcggcctcgtcgccgttgccggtcagggggcgaacggcgccggttgcggtgtccagcagatggatgcaggcgtaatagccttttccatcatctctggcccggcgggacacaaaagctgcgtgagccccgtcgggtgcgaccgccacctcggagaggaatcggtatgcgtacaagtcatctgctttgatgcgttccataattatgcctcctgtttattgagataccgctggtaccagcggagcatttcctccagtcgccggagccgctgacggggccggccggagcgggagagttcgtggttttcccctgggaaaagacacagccgggagggaactccccgcagctggagagcggtgaacatctggatcgcttccagtttccagcagcgatagtcctcctcaccgtggaggaacaatgtgggcgtggtcacatgatcggcatagcgaagaggggactgctgccactggagatcccgatcctcccggtgggaagcgccggtttgccccttggcgaagtagtagccgatgtccgccgtgccctccatcccggtccagtttgcgatggaccgctgggagcaggctgcctggaaccggtccgtgtggccgatgatccagttggtcatgaaaccgccataggacccgccgccaacgcccaaacgggtgggatcgatgtccggccagcgggccagggctccgtccaagaaagccatgatatcctgatagtcgatggtcccgaaccggccccggatatcggcaaagtcatttccacggccctcgcttccacgggggttgcagaacagaacgaagtatccggctcccgccaggacctgcatctcgtgaaagaacaccgagccgtagctcaggcggggcccgccatggatggtcaaaatggctgggtattttttgccgggaacgtaggccaccggcgggagtacccacccctggaccggcagcggacctccggtatccacctccagcggctggggcgtggagacggcgcagcggtcatagatcccgtcgttggcgtgggtcagacggatctcccggccatgctccagagtgtagatctctccgatccggttttcccgaaacgccaggtacaccagccggtctgccgcggcatccaaatactccacactgcccggcccggtgagggggcgggcctcgccggaggtcagatccaaagcctcaatccggctgtcccggtccacggtggagaggaaatagagcgtgtctccgcagacgcgccaggtctctccggcaccaaggcggctgtcggtggccacggtgttgcccacacaatgatggctgtggcggaggagcagctctggttctcctccggagagagggatggtgtagaaatcgccattttccccatttccatagccaagcccgtcggtaagacagagaaccgcctggtcccgccaaagggcaaagagcttcaccagataccggtcctgttccaggaggcaccgggtctctccactggccgcgtcccagataaaaacaccgtggcgcagagtctggacatccgtgaagcgatgaccggtatagaggatccggccatcttccacggtaaagcctgtaaccttgaagggcggcgcggtgaggggggtggttacgccggacgcagggtcgtggatatacaactgggaccgctgcccgctggtgaggcccaggccgttggcccagaagggaatgtcctccagcacatcataggtgcggtttttgtattcctccagggccgaagcttcctccgggggactcagactgtccagatttgggcggttcatgtccacggtggcggtgaaaacgaaccgcccgtccgttaagcgccgggccctgcccgcccgcatggggacggtgaacaggggctgcgcctcgccgccatccaccggcagcgcgtaatatgtagtggtatcctgagaagcggaaccggctgtgcctcgcatcccggaaaagaggatggtccggttatccatccaagaaaaagcccgcaccggactcagggagctgaggggacggtccgcccccgtactgtggtcatagacccacagccgggcgtcatagccattggaggccaaattcgcctgctggcggatataggcagtgtaccgaccgtccggcgagagacccaggtcgctgagatatcggaattgcaggaatgtttcgcagatcataggctccatcatattcactccatttcgtcattgactacaaatttcatcctgtaccagcggcaccgcagatgtgtcctgctgccgggagaggcggcgtctggaaactggaaatagcatcctgattttaattatttatttttaattaaaaataaataattaaaaaatggccccatccttacaaccggcgaagcacaccttcgatatgctgctgtaaacagtgctgggccctcgtgatatctccggaacggatggactctactaggcgaacgtgatctctggctgtgccgctaaagtcccggagccgcaaagggcaaagcagatagttggacactagaaagcgcccctgtacccggtcatacgtctccagcagaatcctgttccctgacgcttctacaagcaaccgatgaaagcggcggtccaacatggcgaattcttttggagaaaaagaactgccggtgaggcggacaccctcttcactgtaacgattcaactgggctaatacggtttctgccgacagcccaaggccggacataaaccgctccagcgcatgtccctctaccatttgacggacttcacacatctggcgcacatgctcctggtcatactccggcacatagatgcggccattacccatgatctgaaggatcccgtcattggccagtaatttaacggcctgaaccaccggcgttcggctgacctcgaagcgatgagccagttcgtccaaggtcaggttttgtcccatctcataatcaccattaatgaggctctcaacaatatgctcatacaaaatttcgtccaggctattctttactttcatggaattcttcctccagttaaaataagtgtaatcgagaacagagaaaaaaacaatagggaatagaagtgtcatttattgggcggcgaaaattcatgataaattcacaaggggttacaagaaattattgttaaaaatgccaacaagatgctatatgcgtttgtttctgattcttatatctaccatctcgcttcacattagataggccttatcaaatatcctatccagccagcagccagtgtgatgaggatgaccacaacatccccgccgggaaattgtgcgagggaagagaaggtgtcagtccaaacagcatcaaaatccatgccaatacaaatggaacgctgtatagcatcagcgcagcttttccgacctttgcaaaaggacgatacaacaagttcagcttcctttccggcagcgccgccgccagcagaaccttgctcccgcctgtcccgatcagcattccaatcacggccccccggacggcatccaatgccagcagcctgacagccgcgggggtaatttttcgtgttgccttttgattcatggggacatccttggtttttatcccctcttgttatcggcggcattgtagcatgaatgaagagcgataggctggattttggccccagatgtgcgtcctcggctttaaatgcgagttagtcctatgcgttcaggacaaattgcatttattcaggacaaaacctttcaatctgatatactgcgggaaaagatggacaagaaaggattccgcctatggtaccgatcgttctttgcgacgacgatcccttcacattgcagcttctgtccgagctgctggaacgggcgatccggcaaagcaaagcagaggccaacttgtctgtctggcctctgctggtcaggagccgctccagtttatccgcagcggtggaagctatctctattttctcgattatgacctgggaagggattccccccaacggcgtggaccttgtccggcagatctaccacacggaccccggcgggaaaatcgtctttgttaccggccatggggagaagggcatggatattctgcgcagcggcgtgcggccctttgggtttattgaaaatgtgtggatcagaatgagatggttcgggagtatattcgatatttgaaaatggcggtgccggagcagcaaaacagcgcggacggggacaccgtcgaactgcccatcgggatcgatgaaacggtacggctgccggtttctgagatattgtatgtggattccgtcaaaacagtggcccattctatttgctgtcatttgacgggtcagggggtgactgcgcgggagacgatcgaacacgcccaggaacagctggaagatcaggttatccgctgccgttgctctgttttagtaagggacattgccgccgctgggcagttcaacgtttgcgataaaataatttttaagacgcagtgataaaggggctgcatatatacgcgcaagatagaacagaatttgtgaagacagcgcctttgcgttcctataaccttggtccgtggagatcggaatttacgaaaaaatacaggaattgttcaggatgccgttacagctgttgacattgatgatgagcgaaccgctctggtgcttgtcagtcttactcctgacgggaatatttgcacagaaagaacttattatgcgatgatttgcgagattgatgcgacggcatgtaaagttacatttcatgttactgacgacgtagcgtagccctcaatcaaatcctggtttacgattgaaccctatgggccgcagagtgcttgcggcctcattctgtttaaaaccgggtatgaaattgcgccctatccgagttctgggatagggcgcattatcccagatattcaattatccgaggtaaacttcaaatgtcgtttggtattctgggttttgaacagaaaatctcggataacgtttttcatgtatggtacagttaaagccactaaaataacgaggaggttttaaccatgtgtcaacagacaaacgaaaacgacattgcatcatgcaggtatcaggaactgaatcccgagatggatgcttttttgtcggaatatcttgaagacggacgacgtaaggggctacaggaaagtacaattcatcttcatgataagattggacattactttttatccgccctaaccagaatcggttgtgtgaaaccgcaggaaatgaatccccaaaatataggaaccgtatgcttatcagtcagcagcaagtggtatctttcccacatccggacatttctccggtatgcttatcagtccggtcataccgacagggattacagtggtattgtccctctttttaaaagaccgcagccatacccttctgtatacacaacagatgaaattctaaaaatcgaaagcagcatagaccagacttccccacacggaaagcgtgattatgcagccctgctccttgcgacgcggctcggaatcagaagcggggacatttcatccatgacattcaaagagctggattttgacagggacctgatcctgcttacccagcataaaaccagtgtcactattgaacttcccatggttcccgatgtaaaaactgctttggagagatatttacaggaagagcgtgccgacaatgaaagtccatatgtgtttctccgaattattccgccttacagccatatctcagtacaggcaatcactaagattgtaaggactgccattgaaacagcaggaatcgatccaggtaaacgcaagcagggagcacatgccttccgggcatcccttgcaagttccatggtcaatgacaacatcccttatgaagtcgtaagaaaaactcttggacatacagaccaaaatgccatccgttcttatgccagtctggacattgagcagcttcggggctacgcactccctgtaccggaagcagcaggtacatttgccggttttctggaaggaaggtggtctttgtcatgaatgaatttaaaagcattttcaaaaacgagctggcggaataccttgcaatcagccagggcacaatcagtgacggtactttacagaatacacgcagaatcctgctttcgttcgactcactgctggcagaagaaaataccggcgaaatctcagaaaggacagtgaatcgttggattggcagacttctccagactaacgcacctaaaacagtcagcgacaaggtgagctatctccggaaatttttaaggtatctccagtatgaaggctacagtgtttttatgcctgactgccctaaaacatcagacagctatgtcccatatattttttcggatgaggaaatacaaatgcttctggccagtgccgatagctggggcagtaggcacacagacccgcaaacgcgacagatggacatggagttctgtatgttactgcggatgcttttgggctgcggattccggttgggggaaccacttgctgccagggtgaaggatataaacttttcccgcggaactatcctgatccgccatgccaagaataacaagcagcgtgtcgttccgatggatgtaacattaaccagaatgctggaaaagtactgcattgcgatggcaatcaaaacagagccggaaagccacctgtttccatcggtcaggaaaaaaggggcagctgttacaaaaggaactttcggattacggttcaggaagctgttacagcaaaccaacctgtgtgtacctggaaaggctcattccagaggtcaatgtcttcattgtttccgtcattactttgccatccattcttttgtacaggcagagaaaaaaggacgtccggtaaatgattctgtaccgttcctgtccgtttatcttggacaccatgacatgaacgagactgagaagtacctgaaattcagcagcgacatgttccccgaatacacggaattgtttgaagactatgctgtcagcgtattcatggaggtgggcgatgaggaaaaataaacttcccgacttcatgcttctgctggaacagttttttacggaatatatgccgctctcatcaggtctttctcctaacaccgtccgatcgtataagcattcttttcggcttctgttccagtatgtttatcaagtgaaaaagaaagatgccggagaaatcgtgtttcaggatctcgattttgaaacaatcgacagtttcctgaaatggatcgaaacagaacggggctgctcggtatccacaaggaacctccggctttcggcactcacatcctttgccgcttacgcacagaacagaaattttgaagcggcgactgtgtttgcgaatgctgtaaggaggattcctgtaaaaaaggcatccagccagccaaggattattttttcgcttgatgaagtgtcagccctgctccggcttcctgacactgaaaaacgcttgggcttccgtgaccaggttcttttaaacctgatgtatgcaagcggagccagggcacaggaaatctgtgatcttaaagtcagagatttccttgttgaaaaaaatctgtacaagctgacaatcacaggaaaagggaataagacccgcaggattgtaatcgctaaacctagcggaatcctcctgaaacggtatctggaagaaacaggcagaactggacggttagatgcctatatcttttccagccagacacatccgcagatgactatctcctgcattgaggaaatttataaaaaatatgttgcccttgccaaggcggagtatccgaagatgtttcttgaaaagtgttataccccgcataccatgagacatacaaccgccacacatatgttagaagccggagtcccgatcatagcaatcaaaaactttctcggacattcctcgatttctacgactgaacggtacgcagagctttcccagagtaccgtgaacaggtatatccgagattggaacgagaaatggttttcacatcaaaaggaaacccctgctaatcagaaggaaaatcagttgcctgattttctgaaatagccattacattatccgaggatatttctttgaaagcctttaatatcagcaatatttaagaatttcctcggataattgaatatctgggataatgcggcattaaaacgcatagtccagcgaatagagtatgaagaagccagggaacggtgatcttttcagattgctgcaccctggctttttgttgtcaattgaaattcaaaaccgggatttcaatttttgtaatatagtcctcgattctgtcgatcaccagttcattgatcccaatctcataggcatagccggagaactgtaaatggtgctgctctgcgtagcggaggatcgcttcatagcgggcaggcagcctgtcccaattcccaatgcagaatgcccgcaaatagaccccgccggggcgcctgtggagtcccatcctgttctgcgtgtccggcagttcgataaacagcttggagtagtcctcaaacctccgggccaggaggttttccaccgggagcatggagccgtagggagtctggtacatacgcggaagctgatatttcttggtctgctcaagaatcagctcgatctcctcctccagggacttttccggtgatgtttgcaccgtcgccagatactgcggttcccgctcaatgagggagatctcggagaggtccaggtccaaaagttcggtcatctcctggcggcggctgcacagttttgaccggacggccttcagcccctggatcgtccggtccagttctgagattttatcccgaagcaggtccgccatgctcccagcggacctgtttttcataaattcctgaatatcccggatgggcacgttcatgtcccggagcagcaggatcacctccagctccgtactctggtaatagctgtatagccggtacccattttcttcgtggataaacgcaggcttgaacagcccgatctcatcataccacatgagtgtctttttgttgatcccatgcagagcggcaaactggccgatggtaaacagcttcggtttttcccgcagcattttcaaaaacccccttgaccgtacagtaactgtagggattatgatactccatgccggtaactaccacaagaagcaggaggaatttccgtgcagaatgaaattgcatacagcagacccgtcaccctgacaaacattcttaaatttgcagtccccaccatcgccatgagcgtattcatgtccttctatacgatggtggacgggctgttcgtctcaaacctgatcgggaccagtgccctgtctgccctcaatctggtctatcccgtcatcgcgctggtgacggccatctccaccatgctcgcaaccggcggcagcgcggctatcatgagaaagatgggagagggaaagcccgatgaagcaaagcaggactttacgtttctgatcctggtcaatgtcctgaccggccttgtgatgtgcgggctgggctatctgttcatggggaagatcttcggctccatgtccctgtccccggaggtctccgcctattgctgggaatatctgagccgttacctgctgttcaccgtccctattcttctgatgaataacttcaccctctatatgatcgcagcaggcaaggcgtccctttccctgctctgctccgtcgccggcggcgtgaccaatatcgtgctggactacctgtttatcgccgttttccgctgggggatcggcggggcggcggttgccaccggcctggggtactccatcacagccatcgtgggcctgctggtgttctccaaccggaacagcctgctccattttgtcaggccggtctgccggccccaaacgctcgggagagccgtcacgaacggctgctctgaaatggccaccgcgctggtcaacggcatcatcacgctgatgttcaactggacgatgctcaaatatgtaggggaggacggcgttgccgcaattaccatcatctcctatgtgctggcctttgccgggtccctgtatgccggttatgcctacggggtggcccccatgctcagcttttattacggggaacagaaccatgagaagctcaggaagctggtccgcaccagcctgaaaatcatcggcgcgatcgcggcggccaccgtgctcgtttctctggctgtcacagagccgctggtgtccatcttcgcccggcccggaacacctgtctatgacctggctgtggcaggaaaccggatctgttccctggccctgctctttgtgggcttcaacatttttgcaagcgggatgttcaccgcactttccaatgggctcatttcggcagtgctggcgttttcccgcacctttgtctttacactgatcgccatgctggtcctcccggtcattctgggcgtcaccgggatctggctggcgacaccggccgcggagctggcggcagtcgtcctgtccgccgtcatgctcctgaaataccggcggcgctactgctattgattccaggggggagtattttgaagctggtgattttgctggccgtaatcgcaggaaaatggcttctgtgcctgtggagcggcctgggcctggttttcctgctcttttggctgaaagggaagcagttcaggggtaatagcgaaaaatgggacgatttctttctcaccctgccgccgcaaaaggtggagcagtacgcgattggtatttatctggccgccgcgctgctctcgtccggcatcagctattgtgtcctgaaatgggcgggcttccagcacagtcttttgatcgcaggtgcgctgtttgtggtcggagccttgattacagagtaccggtggttcacaaaaaagcgggactatgtgctgaagcggtatcaggagatcccgcagacgattttggaaagaagaaatggagaaaacaaaatggatggacagatcgtattgagagaataccagacatcagaccgcccggctttgatcgggatcatccgggagacgtggcagtatgacaagtttgcctcccccaaggcggcgcagaagctggcgcgggcctatctggacagctgcctcaccaatcagacctttacccaggtcgcgctggtggatgaagtcccggtggggattatcatggtcaaagaccgcagggagaagagatgcccgttccgcctcagactgcggatgctcctctccgtggcgtcgctgttcctgtccaaagaggggcgtatggtcactaggttcttttccggcgtggaagagatcgaccagcagctcctccaggacacccagaccgagtaccagggagagattgccttctttgcggtcaattccagataccggggcatcggcctggggaagaagctgtttgatgccgcgcgggattacatgaggaaccggcggatcagcaatttcttcctgttcacagacaccacctgcaattacccgttttatgagtgccggggcatggagcgccgcggggagcgcgtccacacctttgcggcaaagagaaaatccgggaccctgaccatgtttatttacgattccttcatagaatgttaagacagtttctgtcgttttccccttcacgtgtgataaaatgcctttcacggctcaacgataaagaggtgtcttttacgaaatccagacagcgtattctcttcctgaccgcagcggggcttctgattgtcggaggtggatggttcctatactccaccggctttttccaggcggcgtcctctcaggaatccctgcgggcctacattgacgactttgcgccatactcccacctgtgttttttcctgctccaatttctctctgtcgtgctggctccgatccccagcaatattaccgctgccgcgggcggtgttctctttggaacatggccttcctttttcctcaccttcgccgcagtagtcgccggttccctgctgttgttctggttggcccgggtgctgggccgggactttgccgggcgttttgtcagccggaggctgtctgaaaaatatcagcagatcctccagaccaaggctccggtgttcctcactctggcgttccttttcccctttttcccagacgatcttctgtgcatcctggccggcctgtcctcgctctcattccgttgctttgcggtgatcgtcctgcttgcccgcccctggggactgctctttgccagcgccctgggcggcgccgcctttcatgtctctccgtgggcgatggttttgatcggtgtagcggggttagtcctgtttcttctggggatgaaatatggggatcagatcgaagcggccatcctgaagcgcctgtcccggcggaaaggcaatgatgcggcctgctgattgcggcagaggttccggcctctttggctcaatgagaatagcgactgtggacagccccaacaaggcggccgcttccggatttctggcggcgctgtcttgttggggcgtaatcctgctttgagacaactgggattgtgttgggccatggggcggcttgtcttttatttgaacttcccctatactataacgatggatatattttgtatgaaacggagaatttggtgattcttgatgaataaaaaagatttgaaaatgcggccggtaggcaatgagtatctggaacaatataacgccctgctgcgctatgtattccaggtgacggatcaggagctcagttccgtgggctggcaggagaaggagatcatccgggcgaaatttccaaccatgcagaaagcggacgtgatcggctggtttgacggcgacaccctggtttcccaggtggcggtctatccgatgcgcgtcaaggtttttgggaagacctattccatgggcggcctgacgggagtggggacctacccggaatactccaatatgggcctgatgcacaagctgctggagcaggccctgaaaaacatgagggagaaaaagcagtatatctgctatctctacccctattcgatcccctattaccggcgaaagggctgggaactgatctcggacaagatctcgtatgagatcaaggactatcagcttccgaaaaaccaccaggtcgccggcagcgtgcgccgggtgaaggcggacggcgaggaactgaaggagacctacgcccgctttgccgagcatacccacggagccatcctccgggatgagctggcctggaacgaatactggctctgggaccgggacgatatcatggcggcaatctactataacgagaatgaggagccggacgggtatatcatctactggatcgaaaatgaagtgttctatatcaaggacatgattttcaatcatgaggaggcccgcacggggctgtggaactttgtttccgcccacttctccatgatcgaccgggtggagggcagcacctatacggacgagccgctggccttcctgctggaggacgccagcatcaaggagtccatctctccctactatatggcgaggattgtggatttccccgcgttcgtcgcggactatcccttcaaggcggacggtacggagcgggagtggcgcttctccatgacggacccaatcatggagtgcaaccagggctcgttcctgctgaagatatcaaaggacggcagggggacggctgtgaagatctccgagccgtgcgccgacagcatcagcatccagaccatgacgaccatgctgatgggctataagcgcccggactacctcgccaaaatcgggagaatccacgccggcggggagacgattgacatgctggaggacgcgattgagcagcagccgccctatatatccgactatttctaagggccggaatatcattttttcagactacttccacaaaggcaggtgatcccccgctatgcagaaagttgatttgctggagggctccattgttcggagcctgaccagtttagccctgcccatcatggccacgtctttgatccagatggcctacaatatgacggatatgatatggatcggccgcgtatcagccaatgcggtggcggcggtgggcgccgcgggaatgtatctgtggctcgccaacggccttgccatgatcccgcgcctgggcgggcaggtcaaagtggcgcatgagctgggcgcgcaaaatatagaacgtgcggcctcttatgggcaggcggcattccatctcggggccttgctggtggttctgtttacaacgctttgtatcacactcaacgggccgctgatcgcatttttcaggctgaacacgccctctgtgatcgcggacgcacgcacctatctggtaattgtggcggccggatttttcttctcattcttcaatcagatttttacggggatgttcaccgctatggggggaagcgtggtggttctgcgctccacggccatcgggctggtggggaacatcattctggacccgcttatgatctttgggatcggcccattcccgcagatgggcgtggccggagccgccacagccaccgttctggcccaggccatcgtaacagccatgttccttctggcagcccgccgcgagatgaccgtttttccgcaaatccatatattccaggccagtcagtggagggcctgggcggagattttgaaaatcggtttgcctgtctccatccagagcatgtttttctccggcctctccatgatcctcgccaggctcgtcgcgggttggggggacgccgctatcgcggctcagaaggtcggttcgcagatcgagtccatctcctataccacggcggagggatttgccacggcggtcaacgcatttatcgcacaaaacttcggcgcgggccggatggagcgcatccgtaaggggtattggacagccatcggtatgatcgttgtctggagcggcttcaccacacttatgctggtggtctttcctgttccgctgttccggatattcattccggatgaccacgtgctgcagaccggcgtgagctatctgcggatcatgggttactcccagatcttgatgtgcctggagatcacctcctccggcgcgttccagggactgggccgcccaatgccgcccacgctggccggtatcatcgggaacgccgcccgcatccctctggctgtattcctcagcgccacggtactggggctggatggggtctggtggagcatcagcatctccagcattgcaaaaggcatcgtcgtgttcacctggtttgtggtgatcctgcgccgttatacacaccggcaggcgcagggagttgacggactggagtgactgtccgcaggctgattttgggtattgtgccaggatacaatgcctcgaaaatccaccggcaggaggttgtacggttgcgggatattgcataccaagcgtttcaaaaaggaaattgaccttgcgctgctggggatcgagaaatgggcggatgaccgtgcctatttctgcacacccagaaaagccgggatcataggcaggaacggagtatccggagcactgtgccgccatgagttataccgttacgctggaactgcaggacggcgctatgacccttgcggaccgcggcgacggggatcgccccagacaggcgccctgcgccccggatcagccgaagactacttcgtatgtagcagggagcgggtttatcggcggtgcggatggcccggcatccgcttttgttggagaggagcagggaaaacttcggatggcctgttccttgcttcgtttcggcggagaatgtggaatagcggatgattttccacgaaaagcagtttgaggacatgaccctggagtggactccgtcaaatgaggccaagcattccatatctggaagatagaatacggctgaggtgcctgcgctgttagcgccgacgtgacttgaccaaaagagaggtggaaaaatcctagaccaaaatgagtaactaagtatgggacagggcaggtttctatatattttcatcctctggtcaacaattcaagacagccgctgtggaggttcccacagcggctgttcgttatgattgtcaactccgtcccgttctggcattggcaaaccggtcgactataaagttatatacataatagaaaaggacgccgaaacaacacccgatgatgttgtttataatacggaggataattgctgattttaccccaaagatatttgtagccataagaagcgcgccaaaacagttcagaagggttttccaatgataggcggcgcagaggccgagcagcaatcctgaatagattcccagatacgagtgggcggaagccggaagcagttggtatacgatcccaaataaaacactcccagccacgacgccgcccaggcgttgaaatgcccgtttgtttgggcgctcgccatattgcgataggaccgtcaggcaggcacagcccacccacatgatccggtctacctgaagtagttctccgacaaggattccaagcgataatccaagcgtcacctgaaactgccattttccgaggggatcaaagagggaaaagtctttcacgatctgcgagaacgttttgccgtaatctttcttcctgtgattgatgtagaaaatgattccgcacagcaggcatcccagcagcatttcgaatacccggagcacgagcagatgtccgccaaccggattcccgtataggaacatataggcaaacaggtacaggcccgcccctccgtataacggctcgtggcaggcggagatcacgataaagccgatgctcaagaagttgatcagaaacccccacgccggatttacggactgcgcaatgcaagggctgaaggtcagcagcacaaagacaataaagaagtttatcagggagcttttgaggcagtagccgaagtcaacaaaccggaccgtcagcagaatgcagaagattaccacggcggcagagctgttttcatctccaaacagaaagtttagaatagaaataaaaacgactgcaaagagaacacagaggatatccttcacaatcaaggccgcaatcaatttgtgccgttcagacggattcgctgcgtttctgattttccccttacatacagagacatctaattgcatcgcctgataaaagttcatctggaccttcctttctcagagcataatcctatcatatccggcggggaaatcaagaacgtagcctttgtaaaaaaactgtaaacagttccggccattgggactgttaaagccgatccgaattgatgaaaacaggcggcgccttcccttagccggaacaaatcagaaaatttggggagtcactgtcaacggcgtgggtgcaagggagcgggacagggtacttacagcttcagcttcatccggtccgtctgaatgcccctgcctgattagaacagagagttgtcgttgttctgatcggcaggggcgttttgtgtccgaagccatttctgcgcaatggctttggacttttctgaataggagtcctatgttgcctgctaaatacaaacggagcaaaatgaaagcgcaaaatatgaaacggatgcggcggccggactgtcgctccctcgcaccggacatccttcgcagcaacgcatcagccatggagtacaggccagctccggcccactcttttaaaaaatgtttgatctgccgggaccttcctcttaaagcggcagaaaaccgacgctggcaggctgcttgaagttacgactgcttttcaaatagaggatagttctgcgcatctcctgaaaaacggcaggaccttattttcctgctgcatgaatacctgccggaagccatttccaccagttgtacatttccgggcgaatgcggcgcagggtcattccggtcactgccccatcgaacatggggaagttcctgtatagaaaggagtatcagccgccgcaggcggctgattacacacgtacagcgaaactcaccaaaagactcgaatgacaccgcaggtcacggtggtggtaatgattccggcgatgaggacgccaagcgcgatggcggggagggctgtccggagccggaggtccagcacatcggccaccagggcgccggtccaggccccggtccccggcagcgggattgccacgaggatgatcaggccgatggtgcgatactttttcacgattcggcccttgaggtgtgcccggcgctccagccagtcgattttcggtccaacccagctggatttgcgcagccagtcaaaaatacggcggagcaaaagaatgagaaaggggattggaacgagattgccgaggatggcggcagccgccgctgcggctggcggcaggccggcggctataccggccggaattgcaccgcgcagctccagcacaggcaccatggcaatgaggaatgtcatgaggagctcaccgaaaaaagtatcaaacaaatccatagactacaccttttgtataacaaatgtaacgattgcattctaccatagagcgccagatgcagcaatgtttatttttatctgtacgaaatcgaaacatgtatgtgggcggtaagcaatagagggcagacggtacagccttaccctaaaagaagaacggcccaaaccgggaggggggtcgggaggaacatctggcaagccatacattatatatattgggacagagcgtatcaaagtgcatggatcgcagacgatctgccggaatgttacggttatattacaagagctgcaaatctattgcaaacagaaaattgatctgatatgatgcgtctagaacaaatgaggaatcgctcttggctgcccggtacagatacaggaatggctagccacggtatgtgtaccgtgtaaaaaagaggcttcactcaggcgttctgaacttctaaagccgaacgctcaccgaggtagtttggggggggccgcgtttgcggagtgtatctctccaatttgccaaaatgagggaacggcggaaatttaaaggaggtaaacacccaatgaagaagttcctttctctggtactggctctggtgatgaccatgtctctggtcaccgtcagcgccggtgctaaggacttcagtgatgacgacagcatcacctatcaggaagctgttgacgtcatctccgagattggtgttgtcgacggttacaccggcggcgacttcaagcccactgatgtcctgacccgcggtgccgccgccaagatcatctgcaacctgatcctggggcccaccaccgcttccgctctgagcgccagcagcgctccctttaaggatgtgcccgtgagcaacaccttcgcaggctacatcacctactgcgcccaggagaagatcatcaacggctatcccgacggcaccttccgtcccaccggcaccctgaccggcaacgcgttcatgaagatgctgctgggcgccctgggctatgacagcgctgtcgagagctacactggtcccaactggtccgtggccgtcatcaagcaggccgccggtatcggcctggacgacggcaacgacgagttcgtcggctccaaggccgtgacccgtgaggaggctgccctgtacgccttcaacatgctgcaggccaccatggtcgagtacgacgccaagacttctgtcgacatcaacggcgctaccgtgaccatcgccggcgacaaggccaaggagatcgagaacacctctcgtaccgacggctacatcgacgacgacaacaagatgcagttcgctgagagatacttcaccgacctgcgcctgaccaccgacaccaccgatgacttcggccgtcccgccaacacctggcgcttcaagggcgttgaggttggcaccttcgccaagaccgctgacgccacctacaccgccgacgtgaagctgggccagatctactctgacctgggcatgtccgacaaggacgaggctgctcccgtcttcgtggacggcgttgaggccagcgagtccgccaaggtctccaagggcaacgacctgaaggtcagcgagctgaagttcaccaactctcccgttgcgaagtgcaacgtcggcaacggcactctggtcgaggcctatctggatgaggataccaacgatgtcaccatcgtggctatcaacacctacgtggctgaggtcaacaaggttgtggccgagaccaactccaaggatgcttacatcaccctgtccgagctggctgctgagaacggcgccacctccggcctgcgtgccaacgacgagttcgagaccactggtttcgagaacgaccagatcgtcctcttcacctatgccaacaacgagatccagtctgtcaaggctgctgagtccgctgagggcactctgaccagaaaggtttccggcaagtccatcaacctgggtgagaccaagtatgacttctccaagatgtattctgtggacggcggcgagagcagcctgggcatcgacagcgagtatgtcgtgtacctggatgccaacggctatgccatctacgtcgaggagactgagtacaacatcgctgactacgcctatctgcgcgctctgcagggttccagcgttgctttcgcctctgacaaggccgctctgatcacctatgacggcaagatgaagaccgtcgacaccaaggaggactacaccaacgacttcgctggctatggttctgagctgcagattggtaatcccaaatctgagattgtcctggtgaaggagacctccaaaggcgagtatcgcctgaaggatctcgacaccaagaatcccagcattgctaaggccgaggactccttcgagctgcggaacggcgtggcccggatcaacctgactaacaagggcgtgaccaacgcctccgatgccaagcagggcaccgactacatctatgccgacagcaagacggtgttcgtggtgggcacctatgacagcggtgctcgcgagaattggaaggatgctacctatcgcgcctacaccggcatcaacaacgctcccaccatcgtggacgacaacgacagcagcccggctaccaatgccatcggcatgagctactactgccgcaacaagggcgttgccaccatcgtgtacctgagcgtggacgaggctgactacaaggtcaccggcggcaacaacgacgtgatcttcttcgccttcgagtccggcagcaagaagatcgaggactccgacaacgagtactacacctacaacgcagttgtggatggcaagatcgttgagggcgtcaaggtcgatgccagcgtgaagatcgacaaccgcacctccaacggctccttcagcagcaacgtggtcttcactggcgccgattatgacgacggtgtgatcaccggcctggacaaactgggcaactccggcaccgtcaccggcatcaacaaggtgaacaatgagaacgtcgtgcttggctacggcaacggctctgagtccacctatgtggtcgccgacgatgcgaagatcttcttcatcgacgatgacggcaccattaccgagggtgcggtgagcaacatccgccgctccgacgaggatgtcgtgacctacgtcctggaggatggccagatcagctatctgttcatccagcagtacttcgaggataacgaccagtcctcttccggcggcagacaggagctgaccagcatcactggtgtgacctattctgctcccaacctgaccctgactctgaacggcaccaacgccggccagaactacaaggtcaccctgaagatgatcgttgccggtgtgaccactgagctgggcacctacacggtcaccggcgccaccggcgctaccagcaccaccgctgtcctgtccgtgggcactctggccagcatcgctgccagcggcggtatctacatggtctcctgcggcggtcagaacgcaacgttcactgcctaaggaactgtgtcaacgtgctgatgcactaagacaaaaaggattcccggacttctgtccgggaatcctttttatgtgtcaggcatagtcaaagccggtcggcacgccctctgatagcttctctctgcacggacacacggcttgcgaggatttgcacaggctttggcccagttggcagaggaaacgaactggtgaatgagccgttccttcgccgccagcaccggaagagtcgaaggtcccccggacttttgtccgggggcgttcctttgggttacagtttccagccccagaggatgattttcccttccccgttgatggttccggcgtccgtcataaagttcagcgtcttcaggtccttcggcgcgatggaggggatggtgctgtaatagggcgggttcgatgtatcatagatatgctcacagatacaggcaatgggggagagataagttgccagacggatctttgctttgccttgacccaggaggccgctcatctccaggcggcacaggtagttttggtgcgtgcccggatggaaatagctgtctgtcgcaatattgttgcagcgcagatagatatagtgataggctgtggagaggatggggacgatccacacctccgtgtactgcgtgaagtcgatctgtgatacatccacatccacctgcgctgcttcctgcgtgacaggcacttccagaagttttaccagtggacggcctcggcggctgcggctgcctcccggcggatggcggcatcctgagccgttctcgcctgctgctccgccgcgtccgcggctgccagggaggccagggctgtctccagcttctgattgtccccgttgaaatcctccatccggatgcggtccgtcagctcccactggttgagatgaaattgactggtctgctgcaaattcttcaccctttcccgaaaattgtggcgggaaaactcccgctatccaatcccccctgaccggaagaaattgcagaatttcgtgcaacaaaaaattcccccggaccgaagtccgggggaattttcaaccgcgggtacaatcacccttctggcgggtaatcagacacccaacacaaagctctggtcgccgcaggtcaccatgtaggtggagcccgcagacagagcggcagagatggtggcggtcgtcgttgtcgcggcgccagtcacgttggcggtcgtcagcttcaccagggtgccgccgttgaccagggagatggtcacggggtagacctgtccggcgttcgtgccggtcagagtgacagtgacggtgccgctgctgtagcttgcgctgatcccgctcaggaccacgccgctgctaccggcgccctcctgcttgccgttgtcaacttcctggatgaacaggtaggcgatgtcgccgtcagtcacatcgaggaggccgatgtaggtagcagtggagtcggagctgatgttcttcacatcgtcgatcttggtgataacaccatcggtatcgatgtagtacatcttggcgtcagaggcaaccgtgtagcggacgctggcggaagccgtcgtgccgttcaggccgatgctgtaggagccggagagcttccacacgccggtgcccttgagggtggtgtaatcagatgtggagatatcatcagcggaggtcagcagacccttgttgttgtagtcagcattggtcacaacctggttgaccgtgtcgttgccagccacgaccacagagccagcatcctgagcggccttgaccttcacggtggtgatctcgtcgtccacaactgcgttgtacaggtagtactggttgttgtcgccatcggtgatcatcttggtggcggactcagcagccaggaacaccacatcgcgcttgccgttggtgacataggcgccggtggcgtcgatgaaggcgaaggtcaccacatcgctggagccgctggtggtgtagaccatctcaacagccttggtctccacagcgggagaggtggtcggatcatcagacatgatggtgggagcgttcttgatgcccttgtagacggaatagtcagtcttgccgcgggcatcgctctcagccaccacgaacacggtctcactgttgccatacaccgtagtgccggttttggtggtgatagccgcgcgggtgttcttcatctcgaaggtgtcagcgccgccggacagaacgccatttgtagcaatgctggcatcggcagtggtggtgatggtggggttgccattcttatgaacattggcggcctgacgcagagcgtactcgcccttgtcgtcagcgcggtagtagacgatggtgccctccagagaggtgtaatcgtcgtcagtatccaccgtcttcacggagccgtcggacatgaccagctgaacctgatccttgccgaagcggctgttgctgctctgggtgtagagcacatacgcgtactgagaggcgtcgaactcctgctcatccacatagatgaccatgccgttggtatccagatagatgacatagtcgctcttggtggtcatgctggtctcagagccgaaggagaacgcaatgttcttggagtacttgtactcggtatcggccagagtcaggttcttgcccagggtgtacttgtcgagggtgccctccacggactcggccttcacaacggacttgatctcgtccgcgctctgggagtaggtgaacaggaccacatcgtcttcctcgaagttgtcggtattggtctcaaagcgggccttgctgccggagatggacacagaggtagaagcgtccttctcggtcacgaggctctcggagttcacgacaacatagggatcggagaccttctcttccttggaggagatggtgcccacataggtgtcgatgatgcagatggtgacatcgttgttgtcctcatcgtagaagacctcaacggtgctgccgtcagccaccagcttgttgttggcgctggagctggagaccttgacggtgttgcccttggacacggcaacatcatcggcctcgacgccgttgtaatagacctcggcgttcttgtccttctcgctcatgtcgagatcgctgtagatatcacccagcttcacgttgctggtgtaagtcacatcagcggcgtccgcataggtgccgatcttgtcgcccttgaaagtccacttggtggcgggacgggcgaagtcgtcggtggtctcggtcttgtccagcttgtcgaagtagcgctcggcaaactgcaggttgggcttgtgcatgttgttgtcgtaggagccctgcgcaacttccttggccttgtcgccggcgatggtcacggtagcgccgttgatgtcaacagaggtcttggcgtcgtactcgaccatggtggcctgcagcatgttgaaggcgtacagggcagcctcctcacgggtcacggccttggagccgacgaactcgtcgttgccgtcgtccaggccgataccggcagcctgcttgatgacggccacggtccagttggcaccggtgtagccctcaatggcgctgtcatagcccagagcgcccagcagcatcttcatgaacgcattgccgctcagggtggcggtgggacggaaggtgccgtcggcgtagccgttgatgatgccctgctgagagcagtaggtgatgtagcctgcgaacacgttagtcacgggcacatccttgaagggagcggtgtcagcgctcaggtaggaagcggtggtgggccccaggatcaggttgcagatgatcttggcggcggcaccgcgggtcaggacttcagtgggcttgaagtcgccgccggaataaccgtcgacaacgccgatgccgctgatgacgtcgacagcttccttgtaggtgatgctgccgtcatcactgaagtccttggcgccggcgctgacggtgaccagagacatggtcatcaccagagccagtaccagagaaaggaacttcttcattgggtgtttacctcctttaaatttccgccttccgctcccgttttcgtttggagagatacactcctcgcacaacggcttgcggcccttgtgggccagcggttttccgaacaacttcggtagcattttgagttttcatgctaccaaacggctgcaaagcttggaaaccctggaaagtctggtagcaaaattaaagatttggtagcagccaattatggaaattttttgatgcatcagatcagccgaggattgtgatgacatccaatgcgctttccggtaccgctctttctctgaatgatttggtctgaaaggcgggcccgcgctttcttgaaacggatgtcacatcgttgaaaaataaaaatacacaggcattccgcccctcgcagaggtggattccctttgtccggactgcggactgaaaagcgaaggatgattaaaaatgagtgacaaatataatctgctaatttgatacataaatgaaaccattggaatagacaatgaacaagaaatctgatataattttgcgcggtaaaagactattctcgcgagaggagcaatttcatgaagcgaaaaaaaaccgtgccggcagaggtggttccaaaaccggtgaatgatgcggcgcctgtgccggagaaagaccatccgctgtatgaccgcctgtttgttgtgggatttgcggtgctgctgttttttgccatgacggtgcagacggttcccatgagcctgattctggcggctgtggcattggcgctgtcctttggcagggggggctatgcacggtttcgcggccgcctgggaatcccggtcctggggtttctggcctttttgatcctctgcggggccgccagcctgtatacgagcttcggcgcctacgcttacggagaatatgccaagctgctggcgtccggagccctgggcctgctgctgttggcacgcggacgggaacagaacgccggcggactcctgttcagcttctctgccgtgtgcggagtgattgggcttctatgtatcgatgccgggtgccggggaccgctctttcgcggctttgcctcttttatggaggggcttggggatgcagcttatcagagcctggatcaagcgacctatacgggcgcccggtttgacggcatctataacgacgcaaacctgaccggcagcctgatggcgctggcggtcttggtgggactctacctgatccgtacaggacggaaaccgtgggagcgatttgcggcctgctttctgaccggactgtccgcagtggccttttttaccgcgatgagccgtggtgccattctctgctttggcgcgacagtcctctgctatctgttgtttgtgggaaaagggcagcggggccagctgttcctgctcctgtttttcacggcgttatccatgggcgcattcggtctgctgtctatgacgctgctctcctccggctctgttcttgggacattggccgcgttgccatgcggacttgtgctctggggcctgtatgaaggtttgggccagaaggcggcagaggttctcaatggacacccccgcctgatcgcggggattgctaccggtctggtggtgctctgcgctgcgggaacggtggccgcttttacgctgacggagcccttcgtctgcacggaggaaaatgttctttaccggggcgcggacgtcacctccggggagacctataccatcaccggcgactgggacaacggcgatgagatcactctgatggcctatggctccacccaggcgcaggagatggaaaaccggacggagacttattacagcggaccgctgtccgaggcctcctttaccgtgccggaggggattacccgggtactcttccagttccggggaccggaggggactcagatccgctctctgtccctctccgacggtacgaagatccccacatcctatacgctgctgccggaaaacctggtgagccggttccagaagaatctgtttcaggaccgcagcttcctgctgcgggtgcagtatctcaaggacggctggaccctgtttacgcaatcaccgttgacggggcacggcctgggcgctacggagggtctgctgacctcggtgcagcccttcttctaccagtccctctatctgcataaccatatcctgcaggtgatggacgagacgggtctgctgggtcttgcggcgttcctggcgctgatgctgggtgcggcatggctgctggtgcggcggctgcggacacagcaggatggtatggctgcggtattgcttgcctgctgggtgatgatgaatctccacgggttgatggagatctccttctccgtgcggatgttccagtgtgccgcgtttttcctggtccttatgagtgttgtctcctgtggggagcccgcggaggggagaagcggcgtgcggatcctccgggtcgtagggaccctggccgccgcactctggctggtcgtttcctttgcgatgcttttgggcagccagatggcacaggcgcaattcagggacttcgatacgacggatatgacccggtcggaattcctggacagcatggaaaagctggatcggatggacgcctataccgatcaggattataaggtcaaccggatggtcaatgcactgcaggaggggggcagcctcaatctgggtgtggcgtcccgctgtgcccgggaactgcgggagaccggggactttgacgcttgttataaagtcgccgcttactattatctgcccctgcaggatctctccggcttctttgagatcatgcaggagggactggctcaggagcggtctaatgccgatgcgtggaacagtgcctttgatctgtacggacaggcctttgcgcaactggacgagtcgcagatggatgcgtttgtggcaggcgtcttggcaaccatggaacagatggagcaggccaacgagtatttgctggttccggtggcgctggatgaggccaatcaggctctcgcggatagtgtgaccaccgtggagacggaggacctggatgcctctgccgcgtatgcgctgctctctgcggtatttgccgggcagcaggaataagtggaaaagaaaacagaatggtcctgaatccatcggaactatcctgcttttacagaattatggcaaaaaggaaaaagaataagccggaaaacttatcaaaagttacccaaaaacttgagctgcgtcgaaaaatgtgctaaaatataagctgattaactaggaaaaatgacgagaagatgttttctcattcagaagtttatctgtgggtagcatctagaatctgggaagtaccgccggactggcgtgcgatacggacccagccggtcaaatcaaaagcaggatgtgttgtttatatggaaaagatcccgttttccccgccggatattacccaggcggagatcgatgaagtggtggataccttgcggtccggctggatcaccaccggtcccaagagcaaacagtttgagcgggagatcgcggcctattgcggaacggataccgcggtgtgtctcaactccgctaccgccagcctggagctgacgctgcgtgtactggggatcggccccggggacgaggtgatcgtaccggcttatacgtatacagccacagccagcccggtatgtcatgtaggcgccacgctggtgatggtggacagccagccggactgttatgagatggattatgcacagcttgaaaaagccattacgccgcgcaccaaggccatcatcccggtggatgtgggggggatcctgtgtgattacacccgtattttttccatcgtggaagatcgccggggagacttttcaccggcatctcctctgcaggcgcagctggggcggatcgcggtgatcgcggatggcgcgcacagcttcggtgcggtccgcggcggcatccgcagcggtgcatgggcggatttcaccaccttttctttccatgcggtgaagaatctcaccaccgcagagggcggcgcagtgacctggcgcagggatctgggtctggatgatgcggcgctctatcgtcgctatatgctgctgagccttcacggccaggacaaggatgccctggctaagaccaaggccggcgcgtgggaatatgacattgtggcgcctctttacaagtgcaacatgacggacatcatggccgccattggcctggcccagctgcaccggtatgaggaactgctggccaagcggtatgccctggtggagcagtatcatgagctgctggcgagtacggccattcgccccgcccggcacctgacggaggatggccgctccagctgccacctgtatctgacggagctggaggggaagaccctttcccagcgcaatgccgtcattgatgctctggcccagcagggaatcgcctctaatgtccactataaaccactgcctctgctgacggcataccgggatctgggattccggatggaggattatcccaacgcctatggcttgtatgagcgggagctgacgctgccgctgtattccacactgacccaggcccaggcagagcggatctgcggggcactgcgggagatcctgtaggaggaatcatggcaaatacccaaacgttccagcgccttgccccgcccggacggggtgcaatggccgccaagcggctctttgatatcgtctgtgcggcctgcgggctggtggtcctcagtccgttgttcctgatcacggcgttggctgtaggactgacgtctccgggcggtatcctgttctgtcaggaacggatcgggctgggaggcaaaccgtttatcatctataagttccgtaccatgcggaaggaaaattccggattgaagatcacggcttccggggatgaccggatcacaccggtgggccgaatcctgcgcaagaccaagctggacgagttgccccagctgttcaacgtgctgcgggggatatgagttttgtaggcccccggccggaggtacaggagtataccgatttgtacacagaggagcagaggcaggtgtttctggtccgtccggggatcacgggggtggcatccatccgctatcgtaatgaaaacgacctgcttgccgccagcgacgatcccaaccgtacgtatattcaggagatcctgccggaaaagctgcgtctggatctctcgtacatccctcgggccggtgttgttcaggatatcgccctgatttttgaaacattggcggttgtgatccggggataagcaaaagaaaggacaatcgttgctccatggatatttggctcatcaaccactacgcggtgcctccgaaatattatcccctggcccggcagacctgctttgccaggtatctgatggccatgggccacacggtgacgatcttcgccgccagtaccgttcacaactccaacatgaatctcattaccgacggagctccctggcgggatgaggtagtggacggcgtgcactatgtctacatccggtgcatggattaccagggcaacgggctcaagcggatttacaacatctgcgagttcgcctggaagctgcccggtgtgtgccggaagttccccagacccgatgccattgtggccacctctatgccccccacgtcctgtgccatggggattcatctggcccggaaatacggctgccggggcgtggcggagatcgcagatctctggccggagtccattgtggcctatgggatcgccggaccccggaatcccgcggtgctggcccttcggcggctggagaagtggatctatgaaaaggcggatgacgtggtgttcacctgcgagggcggatatgactatatcgtcgagcagggctgggaggggaggatcccccgtgccaagatccactatatcaataacggcgtggatctggcagtctttgatgagaaccgggcgcgctatacggtgcaggacccggacctggaggatccctccgtgttcaaggtcgtctacaccggctccatccggaaggtaaatcatctgggtctgctgctggacgccgccaaagaggttacagaccccagggtaaaatttttgatctggggagacggagatcagcgggcagcgctggagcagcgggtccgggaggaagagatctcaaatgtggtgttcaagggaaaggtggagaagaagtatatccccagcatcgtcagccgggccgatatcaacttgatccatggcggagatcagggaaaggaattgttccggtttggtattagccccaacaagatgttcgactgctttgcggccgggcggcccatcctgatggatctccctgcaaaatataatccagtggagcaatttcaagccgggatttgtctttcgagtgtatcggagattcctgccgccatccggcagattcaggtgctttcgccccaggcctatgagagcctttgcggcaatgccaggaaagctgccgcacggtttgatttccgagttttaacacaggaactgatggagattttggaaaaaaggggatgagccgtgtggaatttacctattcggcatacaaaaacctgatacacctgcttcagacgggcggatatcgggtctgttcctatcacaactggcaggatacagctcgctgtgtgatcctgcggcatgatattgacagcagcttgggccaagcgatggcactagcccgggtggagcgggagctgggtgtgagcagtacttatttcgtgctgcttacaagcgatttctataacccggcctccaaagggagcgtggaaaagctccggtccatccaatccatggggcacgaagttgggctgcactttgacgaaaaggcctatctggaagggacaccggaggagacagtgtcccgcatcctccatgagcgtgatatcctggcttccattctggagacgccggtgactaccgtctctatgcaccggccttcccaagccacgctggagtcggaccttcagattcccggcatgatcaattcctatgggcagacgtttttccatgatttcaaatacctctcggacagccgccggagatggcgggaaccagtggaggaaatcatccgttccggaacatatgaccgcctgcacattctgacccatgccttctggtaccacaaagcagacgaatccatcacagaaaccgtgagtgcgtttatccgttccgcaaatgcggaacgctatggacagatgcaggaaaatatcacagacttggcgagcattgtgatgagggatcggtgtttatgaaaattaaggaaattctggattttctgcagacggcccggatcccgttttcttttacaggtgacccggagagggaagtggaccgattttcttctctctcccactaccgggaggggtccttcacctggatcaaaaagcaggagaacatcccgctgggaatggatctgacgggtctggctctggtattcgttgcggaggatgtcgatggcggtaacgctcccaatgtgatccggacaccggaaagcaagcacgcatttttttcttcgattgagcatttttatgcccaaccagaggagcggcccgccgtggggcagtttacctatatcggtccgcgggtcaagctgggaagaaacgtccggatcggccacaactgcacgctggatggggacatcaccatcggggatgatacggtcatctggaatagtgtggtgctgttgaaccgggtgacggtgggaagccggtgtgatattcactccggtgctgtgattggtcacgatggatatgcctataccgaggatgccgggcatcacaaggtcatggtgaagcattttggcggcgtcagtatcggcaacgatgttctgatcggtgaaaacgtctgtatcagccgtggaaccattgatgacaccgttctggaggacggagtcaagatcgatgcgctggggcatatcgcgcataattgctggtttggaagaaatgcggcaatgccagttccgtgcagtgtcagcggcagcgtgcatgtgggagagaatgcctatctcgccggcgatattatccgcaatcagtgcaccatcggagagaatgcgtttgtaggcttgggtgccgttgttgtgaaagatgttgcccccggtcagaccgtggtgggaaaccctgcaaagccctttatcaaaagaaagcgtgaagaatatgcaatttattgatctaaaagcacagtatcgtgcactaaaagatgagattgatgccaatatccggggcgtgctggactctgcccagtttatcggcggcccttatgtgaaggagctggaggcgcagctggcggccttcaccgaccggaagcactgcatcacctgcgccaacggtacggatgccctacagatcgcctatatggtggcaggtgtgggtgccggggacgcggtgttttgcccggacatgaccttcatctcctccacggagccggccaaaatgtttggggccactgctgtattctgtgacatcacgccggacacctactgcctgagcccggcgggcctggagcggcagatccaggccgtgctgacggagggaaagctgacccccaaggctgcggtggcagtggatattttgggaaatccctgtgactatgatgccatcggggccatctgcgagaaatacggtctgttcctcatcgaggacgcggcccagagtttcggcgcctcctaccatgggaaaaaggcctgcgccttcggccatatcgccaccacgtccttcttcccggcaaagcctttgggctgctatggtgacggcggcgctatctttacggatgacgacgcggtggatcagctgtgccggtctttgtgcgtccacggcaagggccccggcggcaagtacgacaatgtgcgggtaggcatgaactcccggctggatgctatgcaggccgccgtgctgctgcccaaactcagggccctgggcacctatgagatggacgcccgacagatggtggcccaccggtacaacgaggcgtttgccggccggtttgtgacgccctttgtggcggagggctgcgtcagcgcctgggcccagtatgccctgctggcgaaggacaccgcccagcgagacgccatcgtggcctacctgaaggaggccgggatccccaatatgatctactatcccacgccccagcacgcgctgccggtgttccgggacgagcctcattacggagagaccttccacaacgcggacgactactgtgcccggaccttctccctgcccatgcatccctatctggaagaggcggagcagcgcaaggttatcgacgcggttttggagggtctgtgatgaaattatctgaagctgtccggggcgtttccggtacgctggctgcagatggggagttcagctgcatcgcatttgccacggaacaggagcagtcccagtttctgacgtttctggaaaaggaaaaattcctcccggctctggataattccaagatttcctgtgtgctgactacctccgcattggcggaaaagatcccgccccatatcaaaggtgtgttcctctgtgaccggcccaaggctgcactctttgagattcacaaccgcttggctcgccatccggattatgtgggcgcttctgcggctactgtggtgggggaggggtgctccatcagtcccctggcagccattgaccgtgaaaacgtcgtcatcggagaccgcgtgacaattgaaccctttgtggtcatcaagggacgcgtgatcatcggaaatgatgtgaccatccgcagcggtgcggtgatcggttgcaagggattctctttttcaaaggatacacagggtcaaaatgtctctgtggaggatactgcccggatcatcatcgaagaccatgtggaaatttttgaacaggtagccatcagtaccgggatttttccctgggaagagacccggattggagaaaatacaaaagtggatgcccagtgtttcattgcgcacggctcccatatcggtcggaattgcctgctggcgaatggcagccgctgctgcgggaacagccgggtgggagatcacgtctgggtcggcgtcggggcgattgtgtccaaccgcgtgcgcgtgggcgacggcgcccgggtatccctcgggtctgtcgtgacgaaagaagttcccgccgggcagacagtctccggcaactttgcaattgatcatcagaaatttttatccaacttgaaaaagtctttggaggaataattgatatgtccatgaaagaagaactgatcgaaaagatccaaaacaagaccctgtgtatgggtgtctgcggtctgggatacgtgggactgcccctggcggtggataaggcgaaacacgggttccgcaccatcggctttgatgtccaacaggaaaaggtggacatggtgaacgccgggaaaaactacatcggcgacgtggtggacgcggatctggaaaagctggtgaatgccgggatgctcagcgccaccacggatttctcccgggtgtgtgatgtggatttcatcgccatctgcgtgcccacgccgctggacaagcaccagcagccggacatcagctacgtccgggattccaccatcgccatctccaagcacctcagacggggatccatggtagtgctggagtccaccacttatcccggcaccacggaggagctgattcgccccatcctggaggagggcagcggcctcaagtgcggggaggacttttacctgggtttctccccggagcgggtggatccgggcaacctcatctataagaccagcaacacccccaaggttgtgggtgccatcggtgctgacgccacggaggtgatctccatggtgtaccgctccattctggatggggacgtgaccaccgtatcctctcccgccgtggcagagatggagaagatcctggagaacacctatcggaacgtaaacatcggtctgatcaatgagctggccattttgtgcaataaaatgggcattgacatctgggaagtggtggacgccgccaaaaccaagccttacggcttccaggcattctatcccggtcccggcctgggcggccactgcatccccctggatccctattacctcagctggaaggcccgggagtacggcttccacacctccatgatcgaagcgtccatgatggtcaacgaccggatgcctgagtacacggtggagcgggccggaaagatcctcaaccgctataagaaggctctgaacggctccaaggtcctggtgctgggcgtggcctacaagcaggatatcgacgactaccgggagagccccgccatccgggtcatcgaggagttccataaaacgggggccatgacggatttctatgatccctttatccccaagtaccgtcatgaaggccagtggtatcagggcctggaggcgctgacgccggagaccgtcaaagcctatgatctggtcatcatcaccacggcccacaccaaggtggactaccagatggtggccgagtgcggcgtgccggtctttgactgcaagaatgtgaccaagcacattcaaaaccgggagaacatcgaggttctgtaaagccggcagcttctcttttgggaacgcgtccgtatgaaggagtttcaggaatgatcaaagtatgccatatgaccagtgcccatcagccgggagacacgcgtatttttcaaaaggagtgcgtctctctggcaaaggccggttaccaggtttttctggtgcagcggggagagagcggggagaactccggtgtccggatcatcgatgtgggacagccctccggcgggcggcttacccggatgacctcctttgcccgcaaagtgtatgaggcggcactggccgtagacgcagacctttatcaccttcatgatccggagctgcttccctacggaatcaagctcaagcgccgggggaaaaaggtgattttcgacagtcacgagctctatgccgtgcagctgcggcaaaaaccctatctgccgggctggtgcacgcggatcattgcgtttggatatgcgcggtatgagcgttacgtcctccggcgcctggacggggccatctttccctgcaccgtgaacggagaggacccctttgcgggaaggtgtccccacacagcgctggtagacaacagcgtcaagctggaggatttttatgagcggtatgatccggaagccgtacggaaccaggatcagatctgcctgacaggttctttgacggaggcccggggcatcaccagtgcgatccgggctgcggcgtcggcaaagtgtacacttgcgctggctggcccgatctctccggcggactatgaggcccagctccggaagatgccggaattttccagcgtagattaccggggcgtcctggccaaggaccaggtggcagcgcttctgcagaccagccgggtgggcctttctccgcttttgaaccagggccagtattggaaggctgagaatctggccaccaagatctgtgagtatctggccatggggctgccggtggtgatgaacgggtctgcctacaaccgggcattcgtagagcgctggcactgcggcatctgtgtggactcggagaacgtggaggagatcgcctccgctatccggtatctgctggatcatccggaggaggcccggcagatgggagagaatggccgtcaggccgtgcgggaagaattcaactggggcgtggaggaaaaaaagcttctggccctgtacgaggaaattttcaaggaataaaaggggaccatcaacatgaaatacgtgctcatcggctgcggccggatcgccgtcaaccacatcaaagccgtgctgaacaaccacctggaactggccgctgtgtgcgacgtcaagccggaggccatggagaccctcctggccaagcacggcctggagaaggacacttccatccgccgctataccgactatcgggagatgatcgaggcggagcagcccactctggcggccattgccacggagagcggaatccacgcggagatcgccctctactgcatcgcccacggcgtcaacgtcatcatcgaaaagcccatggccatgtccatggcggatgccgacgccattgtggaggctgcccaggcccaccatgtcaaggtgtgcgcctgccaccagaaccggttcaatccggcggtccaggccacccggaaggccctggaggagggccggttcggcaagctctcccacggctccatccatgtgcgctggaaccggaacaagggctattacgaccaggccccctggcgcggcacttgggcccaggacggaggctgcatgatgaaccagtgcatccatggcgtggatcttctgcgctggatgatgggggatgatgtggtggaggtctatgcccagacggctcagcagttccatcactatctggaatgtgaggacgtgggcatggcggtggtgaaattcgccaacggcgccatcggcaccatcgagggcaccaccaacgtctaccccaaaaacctggaagagacgctgtatctcttcggtgagacgggaacggtgaagatcggcggtacctccaccaataacatcgacgtctggcagtttgccgaccaacgggaggaggacgcagccctgcaggggcttcaggaggccaccagcaatgtctacggcaacggccataccgccgtttacgcggatatgatggacgccatcgtccatgaccgggccccgtatatcgacgctcaggccggccgccgggcgctggagatgatccttgccatgtatcagtccgcggccaccggaatgccggtgaaactgccgctcaaggacgtggcctccctggacttcacaggccggtttgacaaaaaagaggagacaaacgggtaaatgaagctgccatctgtcacagaaaaactgcgtgggagccgggcggcccaatccctggagaagctctcccgcgtaagccggaggcatcagtttttgttccagtgcggactgatcctcctctaccggctggtgctggacttcatgtaccttacgcagctctctcccatctacgcctacagcggctttaccacggatctggtgtggatcaaatacgccctttcctggctgctggtattggtgtgtctgcccctggtggtggggctccagggacaggaggaacgtccctcctccatcctggtgacgctgatgaactatgtttactttctcccgatgacgtcctatctgggatgcaagggaagtgatctgggcttcttctgcgcagtggcggtgtactggctggtgctgctggcggtgcagctgcgtatgcccaccatcttggtgcccaaactgccccaccggcatacctccttgttattttttctcgtgagtgtgggggcgtgcctgttcgttatggggatctcggggatctataccggattccggctgaagttgaacctttcagatgtctatgggatccgggcagaggcagcagcctacgatattcccggtctttttgcctacgttctctcctggatgacggtcattttgtccgtgctgatcctgtactggctgcaaaagcgccggtacgtggcggtaggcgtgctggtggtagtctatctgttctattactccatcagcgcacagaagtccgtgtttttgtttctctttttactgctgttctgctacctgctgtaccggaaatggatgtaccgctggtgcgccgggctgttgtcactgggagtcatgggctgctgggtgctggaggccggggcccagtttctcacccccatgtccctgtttgtgcgcaggctcatgtacgtgcctgtccagctcagcgaggtgtacgcccaatttttccgggagcacccgctgaatctgttccgggacgggattttggggaagctgtcctatgacccggtctattccattaagatccccaaggtgatcggagaatatatggggaccggatccagcgccaacaacggtctggtgggtgatatgtatgccaatctgccggtcgtgctgggggttttcctgatgccgctgatcctggtgatcctgttccggctgctggatgcggcagccagagacatcccccaaaagatctatatcgggctgtgtgtgttttttgctatgagtttctgcaacggttcctggagtaccgtcctgctgtccggaggattcctgatggcctgtatcttcctgtatctatttcctgtacaaaaagaggagcacgtaaagaatgaacaatcgtgaactgcgcgttcaggaccttatttccgggttccggcgcgattggaaactatttttggtcattgtggccgggttcctcctgctgggtcttgctgctggattcttcttttccggccgggcctcggcggaagggtccggcagcgcccaggcatgggagccggtggactttgcggaggtccccatgggtatcacctattatgtggactgttacgactacatcaaggagcagcgcaaggtcctctgttcgtacattgacggtgtgcggaacgattcctctattacggaatcgcagcaagagcagctcctagagatgaaagaagaaatcctgatctttgatgaggacgagcttgttcctatctactgggatctgaacgccccggatgcgttttacctgcccgatgagctacgtcagagcactctggctcagtatcggcgggagcgggagacgctgctgcaaaatatcagcaaatccgagtatgccagatctctgctggataccgtgggcggcctgagtaccagcgacgccgccgtcaatgagatctacgcctccattctttcccaggcagcggaataccgccagctgcagctggatctggaacagctggatacccggctgaatctgctggaaaacgagtatcccgcgctgcgccaggccagtgaagaaatggcgcagcgcctcgatgacgccgcccgggcgctggatgcgcgggcggaagaggcagtggccctgctggaggagattgcgcaggaaaaccatctgaatatcaccttctcggcggagcaggaggacgtgacggtccagatcggccacactacccggcccgccacccgacaggaggcatttacggcctttgtgatcttctttggacttgtgggtatctgtgctggcggcttttttgtcctatgccgggagacttcttcctacaaaaaggagtctctgcagcagtgatttgaagatttgaaaggatactctgggatgcagtctcgtttgctgaaaaatattctctctgtcagtggcgtgctgattttggtcaaggcgctgggttttttcaagcagatggtaatcgccggcatttttggcgccaatgccgagactgacctgatcaatctgtcctatggatttatcggcgacatccaatatctgctggttcaagtgatgcttaccgcagtggtatctgtttatattcatgtgaaggaagagacccagaatgaagccgggcagtttgccagcgacaccctttgcgcaggcaccatcgttgtagcggcgatttcagcgaccatttttatgctttccccctggatctcaaaattgctggccccaagctattcccaggaattgagtagccagctcgggggctatattcgcctattttccccgatcctcattccattggtttggatggcggtttttcatgcacttctcaactccaacaaacgctttatcccaggtcaactggagggattgtaccaaagcgtgatcctggttatcgtgattattttgggagcgccctatctgggcgtggactccctagtcattggatattggttgtatgcaaccttcagcgccgggtttctgggttatcaggcgcggacttatttgaggaagagcagtagaaatccgttccgtaatccgcaggtccgttcgcttctcgcaatggttggaccactttctatcggctatggtgcagtttatatcaaccaaatggtagacaaaatcctggtatccggactggcggatgggacggtcactgccatgagctatgccgctacactttccaatctggtagggacactgatttgctccctctgctccgtgctttatgcccatgtaacagaatatatttcgcaggaaaaggaacaggctgtggcccaactgacagaacgggcgattttggttctggtgattctgctgctgcctgtcactgtgatcgcagtaagccaggcggaagacatagtcctgctcatatatggccgcggcgcatttgacgcggaagcggcggctatgacagcccaggcattgatgggctacagcctgagttttatccctttggcgttacgtgaggtatatagccgggtccaatacggatatcaggactctaagcaccccgcggtaaacagtgtcatcggcatcgcctgcaatgttacattgagcattttgctttgtcgaaagttcggtgtatttggagtgacccttgccagcagcgtagccaccctagtaatcggcatgctgaatgtgcagtctgctcgccggaccgcatcattcctgtcgttgaaatctctttggaacttaacaccgaacatattgataggtggaatcctgtccatccttttgacgtggggctgcaagcaatggcttgcagaactgccgctgctgattcggctgtgcttgaccactttctttgtgttctctggatatagtgttttggtcatccctgcggtatggaaaaccgggcttatcaagccatgtcatttttcgcgcaaacaaagatgagcaggaaaaatatcgctactgaagaggagccttctattagcggctggtaatttttatagtccgaggaaggacgctctgcagagatcagaaagaaagcggcgcgtcccatatgcagagtagcctcttttttgagtggtctgctagcgcgctcacgctatgattctttgcctgtccccactcagcttttttggagccgtgcaggcattctgcctcgaatgctggcctcaatttggggctatcttcgcagaaagcagttgtatctctgtgtgcattgccacgggcaacgaatatcaaatgaagggaattattttatgtgtggcatcagtggttatctggatctagaccgtggagtggatattggaatcttgcggcgtatgacggatgtcatccgtcaccgggggccggatgacgagggatatgctttgattggccccggtgggacatcttttttcggggggaacgatacagtaaaagggctggaggtccctccgctggaaactgccgtggggaccgcttcctttttgggatttggtcatcgccgcctgagcatcttggatctgagcgttggtggtcatcagccgatgtatttgccggaacgggatatcaccctcatctacaatggggagttatataactacatggaacttcgcgcccaactggaagctctggggtataccttccacaccaccagcgacacggaagttttactgtatgcctactgcgaatggggtgaagattgtctcacacagttcaacggcatgtgggggtttgctttgtgggatggacaggaaaataagctgttttgcgccagagatcggctgggagccaaaccgttccattactggcgccagggaaaccgtatcatgtttggatcagaactgaagcagctttgtcaggatggtgccgtacaacggcggtttgacacctcttatttggcagctaacctgatatatcatatcagtgattataacgatcagactctgattgaaggcatgaagaccctccgacctggccataagcttgttgtgcagctgggggccggtcataacaccatcgactcctttaccatttcttcctattggacgttgcatgttcattatgataacagtaaaaccgaggcggagtgggtgcggttggtgacagaggagttttccaggtcttgccgctggcgtatgcgtagcgacgcccccctgggggcgcttttgtccggagggctggattcctcctgcatggttactgagatgtgttcgcagatggaagacccctcacggttgcaaacgtttactaccagttatcctggtaacaactcctgtgacgagtggttctttgccgatcttatcaaccgttcctgcggctgtacaggtaaccagatcctaccggatgccgaggacattgaaaagcgttttgagaatttggtgtggcatgtagaagggagctgtggactctctcttttaggcagcaaatttttgttggatgaaatcaatcgccgcggctataaggtgattctcaatggccagtgtggtgatgaattgatgcttggctacgagcgttattatgcattctttttcgcatccctgatcaagagaaagcagtggaagactctggtgtcagaatttcgtcaggccagtcgccattccaaattatctgtgagagatctggccgcttatgcgctctactttaatcagccagtggtgcgggactcacggcagcttcatcgtgccggccggttcatcaaccccgacctgttagaccagcgcaatcgtgtggagttgcgggagttgctgtatccaaaaatactggaaaatctccaatacacggagttgacggcaacccagttgacacatattgtacgctatgacgaccggttgtatatgtcggcttcaattgaaagccggattccttttatggactatcagttcgtggaactgtgctgtcggattccacctgagtacaagatcaaaaatggttacaccaagtatctgatgcggcaggcatttgacagaagaatgcctcgggaagttacctggcgcacgaataaaatgggctttggagcgcctgtgacacagtggggcaggaggttttcgcgggattatctgttggcgtacattgaggattgccgtacagagaagtacttcaaaaaagaggcgcttgcacagatggtaacccgcaatcaagcggaaccgtctatctatgaatttctcgcggttgaactttttgcacggcagtttgatgtgtcataagtatgggacattacaggggaaaactgctttgatatagtttttcgggtggtggaggctatttcgctttttggtgcgaatattgatatatattcgcatccggacaaacaagaggggagatccgcatgacctgtgttaaaagtaaaaataagttactgactacagaagtgtagaaacagaattacaggatgtccttagcggtaaaaaagcaaaaaatgagtggcgcctaggaacttttgttaattgaaaatggatatgaaaagttccacgctggggcgctaaacaaactcacgtcctcctgtgcgcactccgatagcaggagttgcttacacttgattttttgcgccattttatccatttttctatgacaaacacaaaattaaaaaaatctagccgaaaaatggatttgaaaaaatagatggcagaaagatatatttgccactttaaatttcggccataacgctgtataatttgttatatgatcgtaacctaaattaagcggggaacgacacataatgcaattaggagcgtatgggcaagatgaatcatctgcgaaaacagattctctttttgtgtgacagtctgattttaattgttttttcgacttttttctcgtggttttctctgcgatataatctgacggatgcagttggacaatccgttcagctgattcaaaattttgcgttgctttatgcctgcacagtgcttttccaacttttattccgcacgtatgacagcctttggcggtacgctgagagtaaggaatacctgtcgctgctcatggctgcattttgcggatttttcctctacgaggtcttgagccgcatttttctacagagcataatttcctttatgctcctgacttgtgtggccagcctctgggtcttgggaatgctgttgctgcgctttgcctaccgtgtttaccgcagtcgggtactatttagtaagggcagccatcaaatccctgtggccattgtcggtgcaggagcagctggcgttcagctgctggatgagctccagagcaatccagacagccgatacagtgtgcaatgcttttttgatgacgaccttggcaagctgggaaaacgaatccatggcgtggaagtgaaggggacgatcagccaagtgcaggagcgcctgcgcgcgatggatattcaggagatcattgtggcgattccatctgcgggggaaaaccgccgccacgagattttacagaaactgtccggcctcgagcggatcaaaatttctgttttgcccagtacactggacatgatccgccaaaagccgatgcgctctcaactgcgcgaggtccgcattgaggacttattgggccgtgagccggtgtacttggacccagcgcctgtggatgcatatctctctggaaaaaccgtattggtcactggaggcggcggctctatcggttcagagctgtgccgacagattgtcaagcacgatcccaaagagctggtgatcgtggatatctatgagaataacgcctatgatattcagcaggaactgctgtaccagtatggtgggcggctcaatctgaaagtggagatcgcttctatacgggacaggaggcggatgcggcagatcttcgctacataccggccggatgtggtttttcatgccgctgcgcacaaacacgtgccgcttatggaaaacagccctcaggaggcgatccgcaacaatgtatttggcacactaaacctcgtgcgggccgcggatgagttctgtgttcagaagttcctgctgatctccacagacaaagcggtcaatcccacctctgtaatgggcgccagcaaacggctttgcgagatgattcttcagtccatgaaaggacacagcggcacagatttcgtggcggttcgattcggaaatgtcctgggctccaacggctccgtagtaccgctgttccagcggcagatcgccgcggggggaccgatcacggtaacagacaagcgcattatccgttattttatgacaattccggaagctgcgcagttggtgctgcagaccggtgccatggcccggaagaacgagctgtttgttctgaatatgggacaacctgtaaaaatcctggatttggcggaaaatatgatcagactctccgggtatgtgccgtatcgggacattgacattgtggagacggggctgcggcccggcgaaaagctgtacgaggagctgttgattgccagccgggacattgagcagacggagaacagccagatttttatcgagcggcagccggcgattactcccggtgagctgagagagaagctggagattctccaggaggccctggagaaggatgattcctcctgcattcgggaggcgctgcacagggttgtgccaactttccatgagccggaagaggtgaactgcgggcaaggcgccgaggtccgcattccgcaacaggctgctttcagataaagatcagaattttcaaaaaaccgccatgcgaaatgtcagcgcatggcggttttttcaggacagatttcctacacgatataaggagagttctatgaccaatcatttttcccttgccagattcctgctctggattcctccattgctctggtatcgaatcatttggggattttccgcccagacagcgtctgcctccgggaaagtatctgatggacttctgcatcgcatcttaattgtgctgtcgcctgcgtatgcccggtccgaggccgatattcagggggcagctgttgaggtgctctcgttttttgagagaaaagccgcccacatgtttttgtatttccttttggtcatcctgttgttagcggcgcttgcgccctttgtccggaacatcctgcgccggtctgctgccgcgggagttttctgtgccgtcctggcagccctggatgagattcatcagacgtttgttccagggcgcagtggagctgcacgagatgtggcggtcgatttggcgggagccgcaatcgcgtatggtatttggtttctactgcgatgggtaggagccgcgcgaagagaccggcgccggctgtctgcaatccgaacatggatgcccgcagggattggccttctcagtgcctgtattctgccgcaccttacacaatccgccttcagccatccggtttttgagcgcctctgtcagcggttcctggaaaattgggaaacgcttgacgcagccggaaagatcgctgtattagaggggatctctcctgttatgaaggagatgttatatgcgggaacagcggggctgttggggctgatgactatcctgacgctggcaatgcggggatggccgctgctgcgctcgatcacggtatcggtgtcaactgctgcgctggcagcggtcttctttgcggggctgcatagttgctgcttgatcccgggacttttatctatagccatgagtgtccttctgggaagcatggtttgggccagctgcattttaattgtgaaaagcaaagcgctgcttctccataaagaattccagatgtaagcacgaagccccaacgggcttcgtgctctttcaaataagcttatagtgcggccagggaccgccagatcggaatccgatcatatcaaacagaatcaagagcgggccggccaacagcagccataaaagcgcatatctgagacaaatctgccccaaaaaattgccgaaaagagaagtgtaatcccaaagccccaaaccaagccagacattgaaaaccagcccggcggtcaactgggaaacaatcagcacgatccctcccaaaactgcctggagccacagcggaaatgtccagggcattcgttcgttgacagcgtccaaagggatacacaggagggagaatacggcaagatcggtccaatggcagtttccggtcaaaagaagctgtaaagcgcagaaaacgactccgccgcagaaccatcggaatatatgccaaagcagctgcatgatacgtccccctcaaaaaaattatccgtttcccatcctccctgattaggcatgcacaatgctgaacgccggaaacaacagttcccatccggtatgcggatgacggagctccttgccaaggtattcgtgaagaacctcgtgcgcgtggccacaaactcaaggccagtggccaatcggaactgcagtatggaggatttttcgggcagctccgtttgatttctccagtatgcggactggcaacgtgatgtcggaaaccttgcgggaaagcgtctttagatgagctgcatggctatattttggcagcggcaaatgacaagaggccattgttagtttatgcacattaccgcaaaatagaagtcatttccgattttagaaaaatttattactccatagagaaaacgtagattctgctgaacagagaaaggctccggacgggtggccttcattcactgttttccgtgcctgtcgtactcttggggacagcaatctttcgggggtatggcgcgaatgtgccgccgactatcgggtgacattccggttttcagagtgtcgatttcgccgatgcctttttccgggagcgtacagccagctgcaatttctccatgatgttttgggggccggatttccggcggacggagtcttttgtggacgaaacgagggagaaatcgggcacatccgctgcgggggttggagacagtacggttatatctacgaaaaagagaggagccgtttggctaaaatagaaaaaatggcggaggccctggaaaagaagttgatttttctccctaaaaatgatagtttgtaagagagcacgcagagaggcgtgtgattgctttccacatttctgtgaacgaacacagaatggagagaagtgtgcaaaacatgcggcccgctctcacgggaccgctggaaaaattctgaggcttcacaagggggaaattccaatgtttgattccaaccacgtattcctgggcattgcacctatcggctggtgcaacgacgatatgccggagctgggcggggagaacaccttccagcagaccgtcagcgagatggcactggcgggcttcaccggctgcgagatcggcaacaagtatcccaaggatcctgccgagctgaagaaggccctggacctgcgcggcatgcgcatcgccagccgctggtactcatccttcctcctgacccgcccctttgaggaggaggagaaggacttcatcgccaacctggacttcctggctgctgtgggcgccaaccgcatcaacgtcagcgagcagagctactccatccagggcaagatggacgtacccgtgctcaccggcggccacaagcatgtgatggacgacgccgagtggaagctcctgtgcgacggcctgaacaagctgggcaagatcgctgcggaccggggcttcaagctgtgcttccaccaccacatgggcaccgtggtccagaccagcgaggagacggaccgcatgatggccaacaccgatccccggtatgtgttcctgtgctatgacaccggccacttcaccttcgccggcgaggaccccctggctatgctgaagaagtacgtggaccgggtgggccacgtccacctgaaggatatgcggctgcccgtggtggaagaggcccggaagaatgactggtccttcctgcaggccgtccgcaatggcgccttcaccgtccccggtgacggcgacgtggacttcgatcctgtgttcaaggtgctggcggatgccggctaccagggctggctgctggtggaggcggaacaggatcctgccaaggccaatccgctggagtatgccatgaaggcacggaagtacatccgggagcatacgggactctaattcgaagggggactgcgtcccccctcgaccgccccctccccagtgacgtcggtcactggggacgccgcccagggcggctaagtcaatgtattttcggcaggcgcatgtcctgccgaaaatggttgaaatgcatcgcgccgctggcgcgaatggaatttgagcaacaatctttatttaggagatgactccaatggcctatatgaacaagaacgccgagctgaagaacgggtacaatgcctatattgactcctctgtggacgacatgggcacccagatggacgtgggcctgctgctgatggaggcgggggatacctacgtctatgaggatgccaaaaaagaggtggcaatcctcctgttttccggctctgtcacctatgagtgggacggcaagaaggtggaggccgaccggccggactgcttccaccacgatgcctactgcctgctggccggctgcggcacgaaggtgaccatcaccgccaaggcccacagtgagctgtatatccaggccactgtcaacgagacgccctatgaggccgtcatgtacaccccggacaaggtccaggtggagcacaagggctttggcggcgagctgatgggctgcatgtcccgggagatcaagaccttcttcgacctggacaacgcccccttctccaagatggtcctgggcgaggtgctgaatctgcccggcaagtggagctcctatccgccccaccaccatccccagccggaggtgtacttctaccgcttcgactatcccgacggcttcggcgcgggctttgccaacggcgagatcttcaagacgcagcacaatggctgcgccgtcatcaaccatggcttccactcccagaccgccgcgccgggctatgccatgtgctacgcctggggcatccggcacctggagggggatccctgggacaagacccgcatcgacgatccggagcacgcttggctgtggaaggccgatgccaacgaccacatctatcccaatcactgacaggaggtaatcaccccatgaaaaccgttcgtttgaccatggcgcaggctttggtccgtttccttgagaaccagtatatcgaagtggacggcgaacagagccgcttcgtccgcggtgtattcatcatccccggccacggcaacgtggtgggcctgggccaggccctgagccaggaggccaagcacctggagatctggcacggccagaatgagcagggcatggcccaggcagccgtggccttcgccaagcagatgaagcgcaagcagatttgcgtggccacctcctccgtgggccccggcgcggccaacatggtcaccgcctgcggcaccgccaccgccaataacatccccctgttggtgctgcccggcgacgtgtacgcctgccgccagccggaccccgtgctccagcaggtggagcagaccaacaacctctccatctccaccaacgacgccttcaaggccgtctgccgctactgggaccgcatcgtccggccggagcagctgatgagcgccatgatctccgctttccgggtgctgacggaccccgccaacaccggcgccgtctgcatcgccatgcctcaggacgtggagggcgaggcctatgactatcccgagagcttcttcaagaagcgcgtctggcgtctggagcgccgtcccgccaccgaggccgctctggccgacgcggcggaggtcatcaagaaggccaagcggcccattctggtctgcggtggcggcgtccgttactctgaggcccacgaggagttccgggccttcgcagaggccaccggcatccccttcggcgaaacccaggccggcaagagcgccatcgagtggacccaccccctgaacctgggcggcctgggcgtcaccggctgctccgccgccaacgatattgccaagaaggcggacgtggtcatcggcgtgggcacccgctacaccgacttcaccaccgcctccaagtggctgttcaaggacacctgcaagttcgtcaacatcaatgtgtccgagttccaggccctgaagatggacgccgtgcccgtggtggccgacgccaaggatgccctgccccgcctgctggcgaagctggacggctacaaggctccctacaccactgaggtgtccgccgcccgcgagaagtgggccaaggagctggagcgcctggatcatatcacctttgaggacaagaagagctggaaacccatcatcaacgacgccaacgccgactccgccaagcggttcgccaaggacctggacgcaggcctgtgccagaccaccgtgctgggcgccatcaacgccatgatgagcgagggcgacgtggctatcggcgccgccggctccctgcccggcgacatgcagcggatgtggcggcccaccggcatcgactgctataacatggagtacggctactccaccatgggctatgagatcgccggtgccctgggcgtgaagctggccattggcgacaagcgggaagtctacgccatgtgcggtgacggcagcttcaacatgctccacggcgagctggtcaccgctgttatggagcgcaagaagatcaacatctgcctgttcgataacgcctccttcggctgcatcaacaacctgcaggtgggccacggcaacgtgacgctctgcacggagctgcggtaccgcagcaaggacggcctgttcggtgacttcctgaacatcgattacgccaaggtagcggagggctacggctgcaagagctactccatccgcaccatggaggagctggcggcggccttcgaggacgccaagaaggtgaaggaccgcccggtgctgttcgacatcaaggtgctgcccaagaccatgaccgacggctacggctcctggtggcgcgtgggcgacacggaggtgtccgagcggccggagaacctggcggcctatcaggatcacctggaccacgtgagggacgcccggaagtattgatcctctcaagggggagcttgctccccctcgacctccctaccaccagtgacatcggtcactggtgaacggcgccccaggcgcctggggcggggaattttcggcaggcgcatgtcctgccgaaaatgattgaaagatcttctttcgccgctggcgaaagaactgggaaaacacttggtttccccaagtccctttcctgcgggtatcgaaagaggaggagattcgtttgaattgtcctttttgcggcgcggaaatggggagcggcgctttgcaaagcaactatggaatctattggctgccaaagcctcggaaagccggaccaccggacttgtctaaggatgcagagcatttgagcaggcaggataccccgcttattacgccaccttatatcccagcctcccgctgtaccaagtgccggaagattattcttgattactgagctgccgccccggtcggcacgtctatgaccgtccgggccacggtgcggcgggcggttgataaccgcccctacaggaagatctccgggctttcccgaactgccaggagagcggcagcgaaaagcggcgcaggatgtatccctgacttccccgggctggtggtttccccaagggtagcgcgtttccgtccctgactgccgcaagggaccgtcaaccatcccccgccggcggcaggaggtctgcgcctgcgcagaccgacccgccgaacatgttttcttttccaccgggcgcggcgcattttctttttgatgtctcaaaaagaaaatggggggcgcatctgccagacatcatcatagctgcctttccccgctgaaacgggcggccttacaactgcatatcctcattttcaaataaaggaaggtacacaatcatggataaggttctgaaaatcggcatcatcggctgcggcgccatcggcaaggatcactgccgccgcattatcgagacggtccccggcgccacggtcgtggccgtcagcgactatgtggctgctgccgccgacgagactgccgccaagtacggcatcaagtcctatggcaacgactgcgacggcatgatcaaggaccctgaggtggaggccgtggtcatcacctccatcgatcctacccatcacgactacgtcatgaagactctggcagaggagaagtggtgcttctgtgagaagcccctgagccagaacgccaaggactgcgaggagatcatccgccgggagcaggagatcggcaagcggctggtgcaggtgggcttcatgcgccactatgatcggggctacgctgagatgaagcggatcatcgcctccggcgagctgggcaagcccctcatcatcaaggcctgccaccgcaacgtctcccagggcccgggcttcaagaccgagaacggtgtcaccaacgtcgccattcacgagctggacatctgccgctggctgctggatgacgagtatgaggacgtgcagtgcgtgaaggtccgccagtcctccaactccgacaagggctatgataacccccaggtgatgctgatgcgcaccaagaagggctgcttcatcgatgtggaggtccaggtggccgacggctacggctatgacatccagtgcgaggtggtctgcgagaacggcaccgtcaagctgcccgatccctacgccgtggtgtgccgctcccgtcccgccggctgggacagcgtgaagcccgccgagtccatgcccatcatgaccgactggaaggagcgcttcatcgaggcttatgacattgagttctgcaagtgggtggagtccgtccatgccggcaagctcaccggcccctcctcctgggacggctacgtggcctgcgtggctggcgacgctctgaacgcctcccgcggaacctctcagttcctgaaggtggagaccatggaaaagccggaaatgtacaagtaatctgcaaaatcaagcgcaaaaaggccgccctcccgggcggcctttttgcggggatcccctgggaagcgtgaagggtcgagagttgagaacgaagagcgctgctgtttggatagaagctgcctcttcgtatctctgatttccacccctcacgttttgctctgttggaggacttgtttctttttgtttccaatcgttcacaaaatctcccttgttttcgcggtcggaaggctgtaccataaaaacagaacaaagaagatcagacggccgtccgcggccggaaaggaacgatatgaacatacgaaagaaaatcctgactcgctgcggcgccctgctgacggcggttctggtgctggccccaaccgccctggcggcggaggctgagataccgtacatcccccagactgtcccggcggcccagcttgctccggcagaccagagggggcaggaggactggcagctgctgctggtgaacccttggcacacggtgccggagggatatgagatcaagctggccacgttatccaatggactccaggtggacgaacggatctatgatgatctggatgacatgctctccgactgccgggaggcgggcctgaaccccatcgtctgctccgcttaccggacagaggccacccagacccggctgtaccggaacaaggtggcgcgggtccgggcctccggtgtgccggaggaccgggtggaggcggaggccgcccggtgggtggccaagcccggcaccagcgagcaccagaccggcctggctctggacattgtagccgccggctatcagatcctggacgaggaacaggaggacacggcggagcagaagtggctgatggagaacagctggaagtacggcttcatcctccgttatccttcggagaagagcgacatcacaggcatcgggtacgagccctggcactaccgttacgtgggcaaggcggcggcagcggacatctaccgcaccggcgtctgcctggaggagtatctgagccaggaggggccggaggcggagctggcgcctgcgcagacaatccggcaggcggccccggcatccggctctatggagaccgcgccgcagggggcggcggccatctgaaactgcatccacatacacggcggggaaacccgccgtgtatattttccctgaattcctacttgacaaataggattttttgtgagataactataccatagtaattaactgggaaaaggagtgaaccagatgaagatttacgcggacaacgcggccaccactcgggtgagcgacacggcgctggcggccatgacgccctgctttcaggagatctacggcaatccttccagccttcatacgccgggacagcgggcggcggagaagctggcggccgcccgggcgatctttgcacggaacctgcatgcggatccccgggagatcaccttcacctccggcggcagcgaggcggacaaccaggccctccgtaccgcggcggccttgggggagaagcggggcaaacgtcatatcgtctcaacgaaattcgagcaccatgccgtgctccataccctccaggccctggagcgggagggctttgaagtaaccctgctggacattccgccggacggcgtggtgacggcggagcaggtccgggatgccatccggccggacacttgtctggtgagcgtcatgtttgccaacaacgagatcggcaccatccagcccattgctgagatcggcgccgtctgccgccaggcgggggtcctgtttcacacggacgcggtccaggcggcaggccacctgcccatcgatgtggaggcgatgcaggtggacctgctgtccctctccgcccataagttccatgggcccaagggcgtgggagtgctgtacgcccggcgcagtattcctctggctacgctgatccatggcggtgcccaggagcgggggaagcggggcggcacggaggacatccccggcatctgcggcgctgcggccgcctttgacgaggcctgtgccaccatagaacagaacgccgcctacctcacgcctctgcgggacaggctgatcgccggccttaccgccatcccccacaccgcgctgaacggcgattcggcccggcggctgccggggaatgtgaacgtgtgcttcgaggggatcgaaggggagtccctgctgttgctgctggatgaaaagggcatcgccgcctcctccggcagcgcctgtacctccggctccctggaccccagccatgtgctgctggccctggggcggccccacgaggtggctcacggctccctccggctgagcctgagccatgagaaccggccggaggagatcgactatatcctggaggtcctgccggggatcgtgtcctatctgcggggcatgtcccctgtgtgggacgagctggagaccggcctgcggccgcatctgatctgaaaggagacaatgactatggccttatatagtgataaagtgatggaccacttccagcatccccggaacgtggggaagctgcccgacgccgacggcgtgggcgaggtgggcaacgccaagtgcggggatatcatgcggatgtatatccaggtggacccggagacccaagtgattaccgatgtaaagttcaacaccttcggctgcggcagtgccatcgccaccagctctatggctacggagatgatcaagggcaagcctgtttccgaggccctgcagctcaccaaccgggcagtggtggaggctctggacggccttccggcccataagctccactgctctgtccttgcggaagaggcggtgcgggctgctatccgggattactacgaccggaacagcatcccctacggagaggaactgcgggcttgcgaaggacattgcgatacctgcggacattaagaaaacgcctcggagcaatgctccggggcgttgtttctcccaatcaaaaatcatcgtccccgtctagctcgtcctcgtacgggtagcagtccgcgaacatcttctcaaaccggcgctgattcttccggtcgttgggcgtcatccgattcagattcttcagaaaggacaaaatcataccgaagagatatccaaaggtgccgggggcggcggtgagccagatcatcagcgcggaaatcacggccacgcccagaaagccgatcaccgtgcgccaggcgatccggcggagtgccagcgccagatcaaaggccgggacctggtgcttccggcgtctggccagggagatggaggagcaaagcgccaccagggcctgaacgccgaagatgctcatgataagaaaaccggcgacagccgcgcacagaaaatggagggcgattgaggcgatatccatgcagggttctcctcccatgtccaactgagtacgatcattatacaggaaaaccgccggtttgacaaggggtgttcacgcgagccaccatgtccggccgtccaactgtccgtcctggatggtcactacgccataggaggggcgggtgggggcaccgatgctgccgggattcaggaacagtgtccggccccgccggtccaccagaggtctgtgggtgtggccgaagaggaagaggtccagctgttgttcctccgcggcaaaccccgcggtcaccagggactgcttcacgccgtaggtgtggccgtggcacaggagaatacgcttgccccgcagctccagcagccgttccgccggctctgtgggacggaagtcacagttgcccggaacctgttccagggggatggagggaaacctgtcgtggagccgttccccgtcccgccagcagtcccccagatgcagaatcaggtccggggaggtctgctccacggcctgctccatgggactgacggcgccatgggaatccgagagtaccagaattttcataggcatttcctttccggagaggtcttttggttcagtatagaggacggcggcagattttgcaaattttttgcgtggatccccggcgcgctttcccggatgcggaaaaattgaaaaaggggcttgacagagcagagcggctatggtatattctacctgtggttagttaaaactaactaacggcgcgggccgggagcggcccatactttcaacgccggggtttgctaaaactaacttcggcggcaggaacggagggcagtcatggaacggagctttgaagcggtgctggtggaacaatgtgccaccacgctggcgggtgtgaagccggccagcctgttccggtatcagggcgctgacaagcggcagccccgggaggccgcggcccgctgggccaaagagctggccccttacggcatcaccatccgggtcctgaaatactgtccgcagacgggtgcttgtctgatctacctgtaccgggccggatggcttcggtcgatcctctcggagccatccacccgcgcctttctggcggggcaggggtatggggcggatcagagctgtcaggagctgctgaggcagctttccaggcggctgtgcctggagcgggaattcccccatgagatcggcgtctttctgggctaccccctggaggatgtggtgggcttcatccggaaccggggcaggaactacacctgctgcggatactggaaggcctacggcgacccggaggcggcacaaaagcgtttcgatcaataccgccgctgcactgccgcctgctgtgagcagttccggaagggcacggccatcacgcagctgatcgcagcgtgagctccaacacaagctggaaaggaagcaatgctatgaacaaattagccatcgtatactggagcggtaccggcaacacggagaccatggccaactgcatcgcagacggcgccagggagtccggtgcggaggtcgccatgctgccccctggggagttctctgccgcccggttttctgaatttggtgtcgtggccttcggctgccccgccatgggcgccgagcagctggaggaggacgaagtggaacccatgttcgccggattggaggactctctgggcggaaagaagatcgccctgttcggctcctacggctggggcgacggccaatggatgcgggagtggtgcagccgctgcgaggcggcgggcgccaacctgtatgacgaagcgggcctgatcgccaatgattctcccaatgaagaggcccgagaggcctgccgggagttgggccgcaagctggcggcctggtaacatttgctcatcaaagatctttctttgatacttatctccttttttcccctcaacatggccctcgcgcggtgtgcctgccgcgcgggggccgactcctttttcacggctttcaaatttttccgaaaaagggcttgacagccatggttagccatgataaactacaaaaccgaaagaaggttagcaaaagctaaccacagaacagatccaagtggaagaagtgtcttgcagaggagggaggttttatgatgcctctgacaatggcccggccgggagagactgttacgatccgcaagatcaccggcagggatgaggtccggcagcatctggcggagctgggattcgtggtgaacagtgatgtcacggtggtcagccagctggccggcaatctgatcctgcaggtgaaggacagccgggtggcattggacaagaccatggcgaaccggatcatgatttgagagcagagtaggaggaagaatatgaagagcctgaaagatgtcaaggtgggggagaccgccacagtggtcaaactccacggagagggcgctaccaagcgccggatcatggatatgggcattaccaagggcgtggagatccacgtccgcaaggttgcgcctctgggcgatccgatggagctgaatgtgcggggctatgagctcagtgtgcggaaggccgacgcggagaagatcgaggtctcttaaagaggggactgcgtccccctttacgctccggcagacctgcggtctgcctccactattcccccacaccagtgacggtggccactggtgtgtgcgccccagggacgcacgggtcgggggattttcggcaggtacacgccctgccgaaaatgatttcattttgttctttcgccactggcgaaagaaccggggaagccggaggtttcccctggcccccctttcccggatgatgcggggacggtggaaatatcaatggcggctgttgccgctgtttttcaggatgaaagttagcctaaactaacactttggaaggagagaacgatggacatgaagatcgcactggccggcaatccgaactgcggcaagactacgctgttcaacgacttgaccggctccaaccagtacgtgggcaactggcccggcgtcacagtggaaaagaaggagggccggctgaagggacgcaaggatatcgtcatccaggacctgcccggcatttactccctgtccccctatacactggaggaagtggtggcccggaactatctggtgaaggagaagcccgacgccattttgaacatcgtggacggcaccaatatcgagcggaacctgtacctgaccacccagctgatcgaactgggcctgcccgtggtggtggcggtgaacatgatggacctggtccgcagaaacggcgaccagatcgacgccaggaagctgagtgacgccctgggctgccaggtggtggagatcagcgccctgaagggcgagggcggcgtggaggctgcggagctggctgccaagatggcccagcagaagcgcgccgctgaactgccccacgtgttcacgggcagcgtggagcacgccatcgcccacatcgaggagtccatccagggtatggtggacgaccgatatctccgctggtacgcggtgaaggtctttgagcgggacgagaaggtcctggcggacctgaacctgagcacagacctccgggcccacctggaggaccacatcgtggactgcgagaaggagctggatgacgacgcggagagcatcatcaccaaccagcggtatgcgtacatcaacgatctggtgacgaaggccgtcaagaagaagggcgagaaacatcgcctctccacctccgacaagatcgaccagatcgtcaccaaccggatcctggccctgcccatcttcgccgtggtgatgttcgcggtgtattggatcgccatgggtcccttcggcaccttcctgacggactggaccaacgatgtgctgggcactgcctggctggtggagatcccccgtgccgccctggagggctggggcgtcaacgaagtggtcgtgggcctgatctgcgacggcgccctggccggtgtcggcgcggtgctgggcttcgtgccccagatgctggtactgttcctgatgctggccattctggaggacatcggctacatggcgcgaatcgccttcatcatggaccggatcttccggaagttcggcctctccggcaagagcttcatccccatgctggtgggcaccggctgcggtgtccccggcgtcatggcctctcggaccattgagaacgagcgggaccgccgcatgacggtcatgaccacctgcttcatcccctgcggcgctaagatgcccatcatcggcctgatcgccggcgccctgttcggtggctccggcctggtggccgcatccgcttacttcatcggtgtggcggccatcgtcatctccggtatcatcctgaaaaagaccaagatgttcgccggcgacccggcgcccttcgtcatggagctgcctgcttaccacatcccctccgtgggcaacgtactgcgggccacctgggagcggggctggtccttcatcaagcgggccggcacggtgatcctggcctcctctatcatcctgtggttcctccagggcttcggttgggagaacggcgccttcggcctggtggaggacatgaataactccgtcttggccgctatcggcagtgccgtggccttcattttcgtgcccctgggcttcggcaactggcgggccactgtggccgtggtcacgggcctgatcgccaaggagaacgtagtggccaccttcggcgtgctgtacaacttcgctggggagctcagtgagaacggcgacgagatttgggctctggtggcacaggactacaccgccatttccgcctactcctttatgatcttcaacctgctgtgcgccccctgtttcgcggccatgggcgccatcaagcgggagatgaacaacgccaagtggaccgcctttgccatcggctatatgtgcgtgttcgcctatgtggtctccctgattgtctatcagatcggcggcctcatcaccggcgaggtctccttcggcatcggcactgtggtggccgtggtcctggttgtgggcattgtgtacctgctgttccgtaagaacaagtacgaggacgagcggctgaccatccgctcggtggatgccgccggacgccgcgccgccctgaaataagaaaggaagcagccaatgaacgcacccactatcatcgcggccctcatcgtcctggtggtctttgcggccatcgtaggcaagggcatctacaaccggcgtcacggaaagggcggctgctcctgcggcggcgactgcggggcctgcggcggatgccactgcggaaatacccgtcattcctgacgagcggaagcccggccccaccgggcggaaggaggcgttccatttcatggaactgagccaagcgcatctgcggtatctgttggccattggcgagctgtcccagggaaaggcggcggtcagctccacccaggtggcccgggtcctccaggtgtcccgcccctccgtcacccggatgctggctgtcctggcggaaaaggacctggtgaccaaggaacgctacggcaagatcaccctgacggagacgggggcggccctggcccatcagctgcaagcgggcctccgggacctggagcggcggctgccggccctgggcctggacctggaccgggaagagaccgccgccgtggcgggggccctggcctcagtcctgccggagcactgtctccgaaagctctgcacgaccgaatccggcgggacaatgggatgtgccacgccttaaaaaagcagtcctgcggcttttgccgcaggactgcctcttttcttgagcatagaactataaaagagatatgatatattttgagaagacccggggccattgggccgccaggtccttttgtttccgatcctttatcttcacgctctattccagtctctgtaccgcggctcccagcacgccgtcgccgatgtagacgctcaacgtaccatccagctcgccgctccagatgtggtcgtagtttggcagggcggtggtgagcttgccctgcagaatctccatctccgccggagcgccgccgttggccaccgccagattgtaccgcgccgcgccgttgtgggactgcgtcaccagctcgatgagcttgcggatcaccaggttccggccccggaccttggcaatggactggagctgcccgtcggcggcgaaggtgatgaggggcttgatctggagcatggtgcccgccatggccgtcaccttgccgatgcggccgcctttctgtagatattccagcgtgtccacggagaaaaaggggaaggtgttctggatcaaccaaggcacccggcgctctgtcagcgtctgccagtccatcccctgccgcagctcctctgccagctggaggatcatcataccggtgcccagagacccgctgacggagtcatacacccgaatggtcaggtccctccgctcctccgccagcagccgcaccatgttgtaggtgccggataggccgccggagagcatcagggcgatgaccccgtcataccccgccgcggcgatggcgtcaaaggcgtccgaaatgtcctgagcggcgggcagggaggtctgaggcagctctccggaccgcagccgggcatagatgtcggcggcgtggatgtctacgccgtcccggtactctccgtctttgcacaggatccgcaggggcacgacaaagacctggttttccgccgccagttgaggggagaggtccgcgcaggaatccgtgagcagggcgattttttggggtgtcatggtcacatctccaaacctttctctcatgcagggccggcagacctgtccgccggatcggatgatatggtgtgcccattccgtcacaccatatcaatataacctagtatatggaatgctaccgtaaaaatcaagaggaaaatccccgtaggggaacaggaagcccgttcctgtctactggtgaaattttgtagcgagaggacttgccaaaggcggcggatttccggtatgataaaacacaggatctgaaagggaggaaagaccgtgccgctggatgtgaaggccgctgtggcggatgcactgctggagctcattcgccggaaggatgcagacaagatcaccgtgaaggacctggtggaggtctgtgggatctcccgtcagacgttttactaccacttcaaggacattgtggatgtggtggagtgggcggctcagcagggagtccagcgactggtgcgcgagagcctgaacgccgccaccccccaggaggccctgggcgtcttcgtggattttgccgtagaatcccagcccctggttcagcggctgctgaactcccagcggcgggaggccatagagcggatcatggtggacgccacccgtacatacctggcggacagcctgcgggagcggcggggaacgcccgccctccgggccggggactggaagattgccctggatttctatgcctatgggatgaccggactgctgctggagaactgccgccagcgggatctggaccggcaggagctggcggatcagctgttccgcctgctgtccggcgagatggtccgccctccggaaacctgacagatgtgcccgcgtgtcaaagagcttgacacgcgggcatttttgtcaggacagacagcctcctctgccagtggcgcgcacggagcggacgtggtataaccacagcatgagagcggagacagcgcagtgaccggaaaggagtgcgcgcatggaattgagagatggaatgtttgccgtgaagctctgcgagctggagcatcagtacggcctgctgagaagccgcctggagctgtgccagggggcggaccacgagaagatccggcacctgctggcggacgtgctggatgactatcgggaaaacgccctgctgctggagcagagcgcggagggctgccgctccccggcagtggcggagctggcgggcgtccagcgggactactccaaacggatggaggagctgctgcgggacaggctgccccgcctgatgcacggggaagaggacccgcaggaggagcgggcggaggcagcggcccttttcgcggagtacgccatcgacttcgcggcccagggcgtgcgcagcgccctgctggcggccctggccgccatggaccaacagatgaactgtgaggaacaacaaggaaaggaacatcccgtatgaaagaagtcagacccccgaaacggcccttgattttttactactgcgtggccatgctgattctgctgctgttcaacttcctggccatgccctggatggcccgccagcagatccaggaggtggattacggcaccttcatggacatggcggaaaaccaggatctgggccaagtggagatccaggagcaggagaaccagatcgtctttaccaacaaggatgagaccgccgtctactccaccggcatgatcccggatccggacctgaaacagatgctgaaggactccggcgcggagttctccggccaagtcatccagcagacggatcccatcctcagctttctgctgacctggatcctgcccatcgtcatctttgttgccctggggcagtatctctcccggcgcatgatgaagaacatgggcggccccaacgccatggccttcggcaagtccaacgccaaggtgtatgtcaagtcctctgagggcatcaaattctccgacgtggccggagaggacgaggccaaggacaatctcaaggagatcgtggagtacctccacgacccaaagaagtatcaggagatcggcgccaccatgcccaagggcatcctgctggtaggccctcccggcaccggcaagaccatgctggccaaggccgtggcaggcgaggccaacgtgcccttcttctccatctccggctccgacttcgtggaaatgttcgtgggcatgggcgccagcaaggtgcgggacctgttcaagcaggccaaggagaaggccccctgcatcgtgttcatcgacgagatcgacgccatcggccagaagcggaattccggcgcctatggcggaaacgacgagcgggagcagaccctgaaccagctgctgaccgagatggacggctttgagggcaataccggcgtcatcatcctggcggccaccaaccggccggagtccctggaccccgccctgacccggcccggccggtttgaccggcgggtgccggtggagctgccggacctacagggccgggaggatattctgaaggtccacgccaagaagatcaaggtggcggaggacgtggattggggcaaggtggcccgaatggcatccggcgccagcggcgcagagctggccaacatcgtcaacgaggcggcgctgcgggctgtccgggacggccgccgctttgctgcccaggcagatctggaagagagcatcgaggtggtcatcgcaggctaccagaagaagaacgccatcctgacagaccaggagaagaaggtggtggcctaccacgagatcggccacgctttggtcgcggccaagcagaccaattccgcccctgtacagaagatcaccatcgtgccccggacctccggcgccctgggctacaccatgcaggtggaggagggcaaccactacctgatgagccaggaggagctggagaacaagatcgccacgcttaccggcggccgggcggcggaagagctggtcttccactccgcctccaccggcgcctccaatgacatcgagcaggccaccaagctggcccgggccatgattacccggtacggcatgagccctgactttgacatggtggccctggagacagtgcaaaatcagtacttggggggcgacgcctccctggcctgctccgccgagactgcggcggagatcgaccggcaggtggtggagctggtgaagcgccagcacgaaaaggccaaccgaatcctctcggagaaccgggagaagctggacgagctggcccggtatctgtacgaaaaggagacgattaccggtgacgagttcatggagatcctgaatcagtgagcatccgatccgtaaatcagaaaagaggaggcgcccttcggcgcctcctcttttgctgccgtctcacagccccaggccgtagatgcggttggcgttgtcaaagaacaccggctcccagtgtgtctccggcaccagccggcggataaagccgatatattctcccaggttgacaatgggccagtcggtcccgaacatcaccttgtcccagcactggatggccgtcagccaggtgcgcagcaggaacacgtagcccgcctgctcccggaaataggcgtccaggtccacccgcccctccagaaggccggacaggtcggcggccacattgggatttttctccaccactgccgccgcggcctccagaaaggggttgccgaagtggcacatgacgaactgggtatccggatggtctgccgccacctcatccagggccagggggtggcagtatttcagatgggcccgggagaaggcggtcagccccatgtgaacggccaccggcttaccgtaacgggctgccaggcggtagatgggctggtacatggggtccgacagagcgatcttgttgtacccggggtacagcttcacgccgcagcagttgtcccgccgcaggtgcgcctccacccggtccgccaggtccgggatcacccggctcccgtcctccagcaggctgctgtccaggcccacgcagtagtggaacaggtctgtggggtagtcgtgccgccggagctccagactgtgatttcccatcaccacgccgtgggcaatgtgcagttctccatagacctcccgcagatggtctacgttgttgtgatggcccacctgccgggccatctcctcggcagaatcttccgaaaacaggtgcaggtgggcgtcgatgatcttcatacccgcagttctccttccagttcgccccggtatccagcggagcggcgatttttcaacaccgctattataacagagtttgccgccttcgcaacccccgtatgaaaacggttcccgaaaaaagcacagaggtcagtgacctctgtgcttttcctttcgacgcgcctgccgcagctggaacttccgcgcttcctccgcctcccgctgttggcgggtgcgggcgagacgggcctgcttcccctgctcctgttggagcttcagggcctgctgggccttggtgccgatccctgcggcctgggtcatccgccgggcctcccgctggcgccgcttggggcttttgggagggggcagatgctctgtccctggccggggcgggctgaatcgcagcgtccgccagtgttccagaagataggcgtagacctcctggtcccggggctccgcgccgaagacgatccggcagacggagtactccgtgtcatcctcccgctcgtacaggccgatccagaagggatcgtcgaacaggatggtgagcctgcttgtgcccatgcgtgtgtcctcctttaaaggtctcgcacaaagaacggacaaccaaggaggcaggttactgacggcacatgggccgctcccggactaccaaccgggacgtgtttttatctttgcgctatcagcataccacagcgggcgcgggatggcaaggccgggagacaaagcgtcccttttcccatcagccgcggcggtcgtatgatatgataaaagggaccgaaacaagctgtaagatttgatcgcaaaccttgtgtatatcagtgaaggggtaaataagaagcgaggtgaaagccgatggatgacacaacaatcgtccagttatactgggatcgagatgagcgggccatccccgccacatccggcaaatatggaaactactgtaactcgatcgcctggaacatcctgggcaatcgggaagacgccgaagaatgcgtcaatgatacctatctgtgtgcatggacctctatgccgccccacaggcccagggttctgtccgcattcctggggaagctcacgagaaacttgtccctgaaccgatacaagcatcatatcgcggagaaacgaggcggcggagaggccccggctgtgctggatgaaattgcggagctcgtatccgacacggacaacgtggagcgggcagtggaccgcagggaacttgtaagggcgatcgacacttttttggagaggcttccagcggataagaggcgcatttttgtctgccggtactggtatttcgatccggtttccaagatcgcgtcccggtttggaatgacggagaaccatgtatccgtaacactgaatcgcctccggctgaaattacacaactatcttcaggaaaggggctttgacctgtgaaaagagaggaattttgcgaagtcctcggtgacatcaatgagaactatgtgaaagaggccggagcaaatcccaaagccgagaagcggaggcggtttaagtggaaagtgatcgcggcctgtttatgcctgctgcttgcggcgccgctgaccgtattcgccatggataccattcagtatcatgcggcagtggattatctgcgttccctcgggatccccgttgaagatctgagcgactactcccgcacggaaatcaaagaggccgtgaaaacgatggatgcgggagaaagcagcctgctgacggaagaaattctgaacctgctgccagatagcggagaaccgatacaaaggccaacacaggtgacatcagaacaggtcagggaattgacaccgaccatgacgcgagaagaggtcctttcatttttgggcgatacccaggacatcggttccggcatttacatatatatttataaagtagacggagaagcactgctgcggatcccgtttgcaagtgatgaagcgcagctgggggtcacaggagaagaactattaaagaccttatccccgtaagggcgcaggaagggctgatgcggaaacgtcccgttatttccctcccaaaaagggcggcccctacgaccgccaggggagcgcgcagcgactgcgcatccgttgacggctgtgccgccttacggttgcggcgtgcccgatgcgggcaagcggagcgcgcagaaggagggaaaccagcggaacactggtgtcgcaaatactgagagcgccgcagcgcgagacagaaaaacagaggcagatcgaaggcgtccttacaccctgattttggtcggcacttcgccgcgggaatcaactgccaagtctctgcggcactccgccgcgcccgccgggatgccatcgtaaacccgcaggcaccctctcatgccgcccccatacagcaactttgcatgcacgtgccggagcgcgacaaaaggcgttcttttggaatgtgcattgggacaagccgtcatcgcggctgaatccccctatgtgggacccataaaaaagcggctggccttccgtccagccgcctcgtattttctggcaggaaaaatctctcagctccgctgattccccgaattggtggtgtccttcagcagcacgtcatgggctccgccctccacaatggagacggaggacaccagggtcaacttggccttctcccgcagttccgggatggtcagcgcgccgcagttgcacatggtggaccgcaccttggaaagggtggtggccatgccgtccgacagcttgccggcatagggcacgtaggagtccacgccctcctcgaaggagagcttggccgctccgcccaggtcgtaccgctgccagttcctggcccgggcgctgccctcgccccagtactccttcatatagctgccgccgatcagcaccttgctggtgggggactcgtcgaaccgggagaaataccgccccagcatacagaagtccgcgcccatggccagggccagggtgatgtggtagtcctggacaatgccgccgtcggcacagatgggcacgtagacgccggtctcggcaaaataccggtcccgctctgccgccacatcgatgaccgccgtggcctggccccggccgatgcctttggtctcccgggtgatgcagatggagccgccgccgatgcccaccttcacgaagtcggcaccgcaatccgccaggaagcggaagccctcgccatccaccacgttgccggcgcccaccttcacggtgtcgccatagcgggagcgaatccaggccagggtccgcttctgccactcggagtagccctcggaggagtcgatcaccagcacgtccgcgccggcctccaccagggcgggcacccgttcctcatagtcccgggagttgatgccggcgcccaccacataccgcttctgactgtccagcagctccagggggttgcccttgtgggagtcgtagtccttccggaacacgaagctcaccagatgcccgccggcggagacgatgggcagggcgttgagcttgtggtcccagatgatatcattggcggccttcaggctggtgccctccggggcggagacgattttctccgccggggtcatgaattcgctgaccggggtggccgggtccatgcggctcacccggtagtcccggctggtgacgaggcccagcagctttccggtgccggtgccgtcatccgtgaccgccatggtggagtggccggtccgttccttcaaggccagcacgtccgccagcgtgtcccccaggcggagattggagtcgctgatgacaaagcccgccttgtagttcttcaccctccgtaccatctccgcctgctgctcgatgggctgggagacatagatgaaggcgatgccgccctccttcgccagggcgatgcccatctgctctccggataccgcctgcatgacggcggagaccatgggcacgttcatggtgagagcgggctcctccccccgccggtacttcaccaccggggtcttgagggagacgtttgcgggaatgcactccgcggaggagtagccgggcaccagcaggtactcactgaaggtacgggagggctcggagaaaaaataagccatagggccacctcatttcatcagatttcaagtggaagctggatttacaggtccagctggaaaaacagtgtggactccacaggactgtcgttgtagcaggggatctcgtaaaatcccagctgccggtagaggcggacggcatcctccagaaccggcagggtgtccagcagcatacagcggtagccgatctgccgcgcgtcctctgtgatccggcggatcagctgccgggcaagcccccggccccggtactgcggctggacgtacaggcgcttcatttcgcatcgctcgccgtccagccgccgcagggcgatacagcccgccgcccgcccgtccacccgggccaggtacagccgtccgtccggcggggcgtacttggcggcgggggcgcgcagctcgtccgcatagtgctggatgtccagatagatttgaaaagctgggtcgtgcgtcaccagcatggcggtgtacgcctcaaacagggcccgaacgtctgagagggcattataggccggttcgatcacaacggttgaatccatattcaagcacctcccggcggatgtttcagatatgatacccggttccggccggtctgtcaaccgttagagagaaaaatagtcctttgcggcatcgaacaggccaagatcgtaattccccgggatatttcggtacaggcagggccccacccgctcggcgtgccccatcttgccgaagacccggccgtcgggtgaggtgatgccctctaccgaccagacggagccgttggggttgccgtcgatatccatggtgggatggccgtccagatccacgtactgggtggcgatctggccgttttccgccaactgtgccaagagatccggcgggcagaggaaccgcccttccccgtgggagatggggacgctgacgatgtcccccacctggaccttggtcagccagggggaccggttggaggccacccgggtccggacgatccgggactggtggcggccgatgacattgtaagtcagcgtggggcaggcggcatctgtgtcccggatttctccgaaggggaccagccccagcttgatgagggcctggaagccgttgcagatgcccaggacgaggccatcccggttttgcagcaggtccatcaccgcgtctgcggcctggggggaccggagaaaggcggtgatgaacttgccggagccgtcgggctcgtcgccgccggagaagccgccgggcaggaagaggatctgactgctccgggctgcctgggcaaaccgggcggcggatgccgccacatggtccggtgtctgattattcagcaccaggatctgcggctccaggccagcccgtagcgccgcccgggcgctgtcgtactcgcagttggtgccgggaaacacaggaatcagcacctttggctttgccgtgcctgtccggggagcggcgcgggagaaggccggggcctccagtaccggcaccagcgcaggatcggcagggactcggctggggtatacatcctccagcacggactcgttcagggagagcagctcgtcgatggagacgctgtcagcgccggtggtgaggaccggctccgccgtggtggtgcccagcctgacggcgcagaggaggtctgtgtcctccgtcagctccgccacaatggcgccagggcacggcaggtcccaggcgatctcacgcccctcggcctgaaagccgatggagttaccgaaggacatctgcataatcccctcggcgatgccgtgctccaccgcccaggcggagcacaccctgcccgcccggcaaagctggtggaaggtctcccaggcttccctctggctctgggcgccgccgttggcgggagcaaagaggtacaccggatgtcccgcctccttgaactcgggggagagcacctccccggcccggatgggggcgatggcaaaggagatgagggtagggggcacgtccagatcgttgaaggtgccggacatggagtccttgccgccgatggccgccgcgccgaagtccagctgggcgtccagagcccccagcagggcggcgaagggcttgccccagcgtgcggggtcctcccggagcttttcaaagaactcctggagggtgaggtaggcccttcgatagtctgccccggcggccaccagcttggcaagggaggtgaccacaccgttataggccccccggtaggggtccgccgccatagcctccgggtcgaagccccaggccataacgctggcctggtccgtctcctgccccggcagcaccggcagaagggcggccatcacctgggcgggggttctctgatttctgccgccgaagggcatcaacacgctgccacagccgatggtggaatcgaaccgctccgccagccctctgcgggaggcggacgccagactggaggctatggagcggagggaggagttttcggcatcctgggagaccggggacgcgggaatgggggcaggaaccgccgcccgggcgtgcttcacggcgccgttggtgttcaggaagtcccggctcaggtccacgatggtcctgccccgccagcgcatcaccatccggggggacgccgtcaccaccgccacggggtacgcttccagattctccgcctccgcggcggcgatgaatcggtctgcgtttgaccgggccaccaccactgccattcgctcctgggactcggagatggccagctctgtgccgtccaggccgtcgtacttcttccgcactgcgtccagatcgatatccaggccgtccgccagctcacccacggccacggatacgccgcctgcgccgaagtcgttgcaccgcttgatgagccgggtgacattcccatcccggaacagccgctggatcttccgctcctccggggcgttgcccttctggacctcgctggccatggtggtgagagactgcctgttgtggctcttggaggagccggtggcgccgccgatgccgtcccggccggtgcgcccccccagcaggatcaccacgtccccgggctggggccgttcgcggaccacattctccgccggggcggcggccaccaccacgccgcactccaaatgcttggcgatgtagccggggtgatatacctcgctgaccagccctgtggccaggccgatctggttgccgtaggaggagtagcccgccgcggcggtctgggcgagcttgcgctggggcagcttgccggacagggtctccgccaccggcgtccgggggtcgccgcagccggtgagccgcatggcctggtggacgtaggcccggccggacaggggatcccggatgcagccgccgatgcaggtggccgcgccgccgaagggctcgatctccgtggggtggttgtgggtttcgttcttgaacatcagcagccagtcctggggcttgtcgttcacctgggcggcgacatggatggagcaggcgttgatctcctcactctcgtcaatttccggcagaagcccccgtcgcttcagcaccttggcgccgatggtggcgatatccatgagggtctgtggccgctgggcagctttctctgtcccatagacctcctcccgggcggccagataccggttataggcggcctggaccgccggatcgttgatctccacgtggtccagatgggtggagaacgtggtgtggcggcagtggtcggaccagtaggtgtccaccacccggatctccgtcagggtggggtcccggcgctccgagtcccggaagtatgcctggaggaacgacaggtcctccaggtccatggcgagacccagccgcgccagcagggtatccaggcccgcccggtccagggcagtgaagcccgtgaccgtttccacgtctgccgggacggcggtctctgccgccagccgctccggcaggtccaaagacgcctcccggcactccacggggttgaggacataccgcttcaccgcgtccacatccgccgccgtcaggggaccgaagagcagatagatcctggcggtgcggaccgtgggccgctcctcctgagtcatcagctgaatacactgggcggcggagtccgcccgctggtcgaactgtcccggcaggggctccacgccgaaggcgatgcagtccccggcgggcagggctgcggcagtatcgtccacctgaggctcagagaacactgtccccaccgcccggcggaaggcggcctcgtccaggccctccacgtcatagcggttcagcaggcgcaggtcctccaaggcggagacgcccaccacggtctgcagctcgtgcagcaggccccgggcctcctgccggagccccggcttcttttccacatagatccgtcttaccatcgtatgacctcccggcgccggttgggcgctcatcaaaatatgcgtttcagtccgccagagccgccagagcccgctggccgatgtcatggcgcaggtatttgccgtcaaagtccaccgccctggcggcggcgtaggcgtcgtgcaaagcctgccgcaaagtgggaccggtggcggtgacgcccagtacccggccgccgctggtgaccagctgcccattctcgtccagtctgtccccggcgtggtagatggtcacgtttcccggtgccgacgcgggcagagagatgggcttacccttttcgtagtgccctggatacccgccggaggccaagatcacacaggcggcggaggcgtgccgccattccacggtgagcgatcccagggtctcgctttccaccgcctgcatgaccgtcagcaggtctgttttcagcaggggcagcaccacctgggtctccgggtccccgaagcggcagttgtactcgatgaccttgggcccgtccggggtcagcatcaaaccgaagtacaggcagcccttgaaggggcagctttccgcccgcatggcggccagagtgggcaggaagatggtgtccatgcacactcgggcgatgtcctcggtgtagcaggggttgggagccacggtgcccatgccgccggtgttggggccagtatctccgtcccccacccgcttgtggtccatggaggacaccatgggggcgatggcggtgccgtcggtgaaagccaggacgctgacctccgggccagtcaaaaactcctcgatcaccacccggctgccggagtccccgaaggcccggtcctccatcatggtcctgacggcatcctctgcctcttcataggaccgggagatcagcacgcccttgcccagggccagaccgtccgccttgatgacgatggggaaggaggcggttttcaaataggcgagcgccgcagcgggcgtatcgaacacctcatatcgggcggtggggatgtgatattttttcatcaggtccttggcaaagaccttgctggactcgatccgggcggctctggcgtccggcccgaagcaggggatgcccgcggcgtggagggcgtccacacaccccagagccagaggatcgtccggcgccaccaccgcgaaccccacggcgtgggagacggcgaagtccacaatagcgccgatgtctgtggcgctgatctgcggcacacaaacggcgtcagcggcgatgccgccgttgcccggcagggcgtaaatcgtctccaccaccggattttctttcagttttttgatgatggcgtgctcccggccgccgccgcctactacgagaagatccatcgaatcgtcctccttgcttcgtgtataaaacagtgtgaagagagaccggggaaaaccggacaggctttcccggttgatttgccatcgcaaatcagaaaaggaaacttcattgcccctatccgggcccagactcggcagacccggcggcaggatgccggacaggcccgcttctcttcaaagacgctcagtggtggaacagccgcatccctgtaaacgctatcaccatgccgtatttgttggctgtttcaatgacatggtcatcccggatggaaccgccgggctcaacgatgtactggacgccggattttctcgcccgctccacattatcgccgaaggggaagaaggcgtcggagccgcatgtgacgccggtgagggctgcgatccaggtttttttctcctccgccgtcagaggatcggggcgcacggcgaaggtcttctgccagatgccctccgccagcacgtcctcatactcgtcggagagatatacatcgatggcgttatcccggtccgggcggcgaatgttctccacgaattgcaggcccagcaccttgggatggtggcggagccaccaggtgtccgccttggtgcccgccaggcgggtgcagtggatgcggctctgctggcccgctcccacgccgatggcctgtccgtccttcacgtagcagacggagttggactgggtgtatttcagggtgatgagggccacgatcatgtcccgcttggccgcttccggcaggtccttgttctccgtgacaaggttggtgaggagcgcctcattgatctcaaagttgttccgcccctgttggaaggtgacgccgaacgcgtccttgtactcctggggggcggggacgtagtccgggtcgatctgcacgacgttgtaattgcccttcttcttggttttcaatatctccagggcttcgtcggtgtagccgggggcgatgatgccgtcggacacctcatatttcagataccgggcggtggcggcgtcgcacacgtcggagagggccgcccagtccccgtaggagcacagccggtccgcaccccgggcccggatgtaggcacaggcgatgggggaaaggtctgcgccctcctccacaaagtacatctgccgctccacatccctgagggggttgcccacggcggccccggcgggggacacgtgcttgaaggacgcggcggcgggcaggccggtggcttctttcagttcccgcaccagctgccaggcgttcagcgcgtccagaaagttgatgtatcccggcttgccgttcagcaccgtgaggggcaggtcggacccgtcccgcatgaagatgcgggcgggcttctggttgggattgcagccgtatttcagttccagttcgttcatgcctgggtctcctttccggaatacttgttgacgatgcgctgctggaagtcccgggtctccaggtctgtgaagcggacgaagagggagatcctgttggcctcgtccagagcgtcccaaacggcgctggcgaggctgtcaatgtccccttccacggccacctgctccggctctccggcaaaggagggcaggggatcgccgtctccggcgtaggtgtggaggaagtggccggtccccggctggccgggatactcgaaggtctgccgcaggcagcgtctgccggtcccgtcggcggctttcaggatggacagcttgtaactgccgttgggccccagcagcccggaaatccgcggggtccagttgggaccgtccggctcgaattcccgcgtgcggagggcctgctccatgggaaggccctgctttaaaaactccaggatggtgtccgtctggtccccgttggtgacgatgagtccccggcccatctgccgtaccgggtggtagatgatgaggctggggtcctccatcctggcggggtccgccgcctgggtacggatgccgtccggctcctccgcgaagacgcggttgcggctgttggcgctgcggcccatgatgaaatagacggccacggacgacttgccgtccggcgtcatgcccagcacgatcccacggccgggatagggattgccccgcagcagggcacataaatcctgtttcacagatgctcctccttttccgtggcgatgtgggcggccagctgttctgcggcctggggcagcagcacccactccgcctgttccatgacccggcgctgcaaggtttccggcgtgtcgccgggcagaatgtccaccgctttctgcagcaggatgcgccccccgtccgggatctcgttcaccagatggacggtagcgccggtgaccctgacgccacggcggagggctgcctcatggaccttcagcccgtaataccccttcccacagaaggcggggatcagggagggatggacgttgacgatccggtccggccagcgacggacgaagtccgcggacaggatggacaggaacccggccagcacgaccagatccacccggtactgcgtcagcgcctccatcagcgccgcctcaaacggctcctgccccagctgcttccgggacaggggaatggcaggcacgccgcggcgttttgcccgctccagagcgtaggcttcgggattgctggagaggaccagcacgatctccacgtggggcagggcgcctgcttcctgagcgttcagcagcgcctccaggttggtgccgccgccggagaccagcacagcgatacgggccttgttcagcataggatcacccgttcctctccggagatcacctcacctatcacatagccggggcagccgtgctgggccagggcggagagggcctggtccgccgtgtcccgggagacgatcaccgccatgccgacccccatgttgaaggtgttgaacatgtcccgctccgggatgtggccggtctcccggagcattttgaagatgggtggcgtccggacggcagccttctcaattttcaccgtcatcccatccggcaggcaccgggggatgttctcataaaagcccccgccggtgatgtggctgatgccgtggacctctgccgcgtcgatggcggccagcaccggcttcacatagatgcgggtgggggtcagcagggcctcgcccaggctctcccccagatcttcacagtagaccgtcagattggcatgctccacgtgaaagaccttccgcaccagggagaatccgttggagtggaggccggaggagggcagggccagcaccacgtccccggagcggacccggtccgggtcgatgatatcgcccttgtccacgatgcccacggaaaagcccgccaggtcgtattcctccggcgccatgatgccggggtgctcggcagtctcgccgccgatgagggcgcagcccgcctggacgcagccctctgccacgccggagacaatggcggccaccttctccggcacattcttgccgatggcgatgtagtccagaaagaacaggggctttgccccgcagcagatgatgtcgttgacgcacatggccacgcagtccacgcccacggtgtcgtgccggtccagcagctgggcgatgcggattttggtgcccaccccatcggtgccggacaccagcaccggctcacgtatgccggtcaggtccggggcgaacaacccgccaaagcctccaatgccggacactaccccggggatcctggtccgggccacgtggggggccatcagcttcacaccggcgtagcctgcggtgatgtccacgccggacttccggtagctctccgaataactctccatatcaggtcctctccctctcactgatcttgcactcgaatcggtctttgccgccgtcctggggcacggcggtggggtagcccccgccgaagcaggcggtgcagaagccgcactgggtattgtccgccagcttcaccacgtcctgcaggctcagataccccagggaatccacaccgatgatctttgcgatctcctccaccgagtggttgttggcgatgagcttgctggggtcatcgatgtccgtaccgtagtagcaggcggccacaaagggcggcgcgctgacccgcatgtggatctccttcgccccggctttccgcagcaggtcgatggtccggcggcaggtggtgccccggacgatggagtcgtcgatcagcaccacccgcttgccctccaccacggagcggatggggttcagcttgatattgacctcgttttcccgcatggcctgagtgggggagatgaaggtgcggccgatgtacttgttcttgatgaaccccatgccgtaggggataccgctctgccgggcgtagcccagggcggcgtccaggccggagtccggcacaccgatgacgatgtccgcctggaccgggtgctccagggccaggaaggccccggcccgctgccgtgccacgtggacgctggacccgtcgatgacggagtccggccgggcgaagtagatgaactcgaacacgcagagccgcttggggaccttgccgcagtggcgggtgtcggacttgacgccggacttgtccgccaccacgatctccccgggcaggatgtcccgctcgaaccgggcgccgatggcgtccagggcgcaggactcggaggcgaacaccacgcccccgtcccgcagtcgtcccatgcacagcggccggaagccgtgggggtcccggacggcgatgagcttggtgggggaggagatcaccagggagtaggccccctcgatccggtccatggcggcggagaccgcctcctcgatggagggggcgcgcaaacgctcctggacgatgatgtaggcgatgacctcggagtccgtggtggtctggaagatggagccctggctctccagctcctggcgcaatgcgtgggagttggtgaggttgccgttgtgggccagggccatgcggcccttgtagtggttcaccaggatgggctggacgttccgcttgttgtcggacccggtggtgccgtagcgcacgtggcctacggcgatggtgcccgtgcccagggagcggagccgctccgccggaaacacctcgttcaccagccccacatcccggtacgcggtgaacacgccatcatcgttcaccgcgatgccggcgctctcttggccccggtgctggagggcgtacagggcgtaataggccaggggggccacatccgtcgtctccggcgcgtacacgccgaacacgccgcactcctcttggatgtggcgggccgggagcacggcgctcagctcagtcggcatcatgggcaagcagtctctgcatgacctcggcataggcgccctccacgccgcccaggtcccggcggaagcggtccttgtccagcttctcatgggtcttttcgtcccagaggcggcaggtgtcggggctgatctcgtccgccagaacgatcgtgccgtcggtcagtctgccgaactccagcttgaagtccaccagcgtgacgccgcactctgcccagaaggccttgagaatgtcgttgacggcaaaggcgtacttcttgatggtctcgatctcctccgctgtggccagcttcagcgccagggcgtgatagctgttcagcaggggatctcccagttcgtcgttcttgtaggagaactcgatggtgggagcgtcgaatacgatgccctcctccacaccgtaccgcttggcgaaggacccggcagagaggttgcggatgataacctccagcggcacgatggagaccttcttcaccagggtctcccgctcactcagctcctgaacgaagtgggtgggaatgccggccttttcgatccgccgcatcagatggttggtcatctggttgttgatgacgcccttgcccgcaatggtgcccttcttcaggccgttgaaggcggtggcgtcgtccttgtagtccacgatgtaaagttccgggtcgtcggtgcggaagaccttcttggcctttccctcatagagctgttccagcttctgcatggtgcgttcgtcctttctttctgttgagagattagatatttgaataggcaattgataaaccattagaaaaacggaagggaaagagaaaatagaaatgagaaatcagaaatccggccgcgggatggcgcggatacggaactttgagccgtccggtcaggacggactcaagactttccgattcctcatttccgatttctcacgatttcaggagttcctcctggagcttggcgtccttctcggcgatctgctccgccatcttccgccgctccgcttccaggcgccgggtcagggcctcgtcctccaccgccaggatctgggcggccagcacagcagcatttttcgcgccgttcagtgctaccgtagccaccgggatgccgccgggcatctggactgtggccagcagggcatccagtccatccaggacgccccccttcatgggaatgccgatgacaggcagggtggtgttggcggcaaaggcccccgccagatgggcagccatgccggcggcgcagatgaccacgccgaatccccgctcccgggcggacttggcgaactcagccgcctgggtcggcgtccggtgggcgctgaggatatgggcctcataggggatgtccagggcgtccagctgggtacaggcccctttgaccacgggccagtcactgtcgctgcccatgatgacggcaacttttttcatcgcaagcgctcctttctgcggctcagagttttttccgcatgacggtgtggcggaagatgccgtccacaaaatactcgctggagcagaacacggggcgtccgtcgatgtcatagtccacctcttccatgttcagcagcggcgtgcccatgggcacctggaagatctccgccagggcggcatccgccgcggcgggccgcacgtctgtcagatccagatagggatagatgccgcagaaccgctggaggaagtggaagatggggagcttgaagtcctggatggtgtaatcccccttggccagggccttttccaccacgtcctcgcagtagatggcgggccggccatccgcggtgcacagccgggcgatgcggatgatgggggtgtcctccggaatgcggagctgagcggccacctgggcatcggcagtcccatcggaaacccggacaaaggccaccgccggctcatgtccgctctggcggatcatgtccaggaactctacctcaatgtccatgcgggtctggacgttcagcacatggcggttgatgatggtgccaactccgtggcggcgggtgatgaagccctcccgctccagagaggccagaatgtcccgcagctgcgtgcggctgattcccagcttctctgccaggacactctcccggggcaggcgctcgcagctggcgtaggcaccgtccttcatgtcggcaagcagctgagagcggatggtcttggtctgggccggctgaccgctcatagtcacacctctttctgatcttaaaataggtaataccataaaagtcatacctattgtaccggattttctccggcgccgcaactggcagatttgacagattccgccctccttttttgccccggcatatccagtctgctgttgacggcaggacgcacgggccggaggcgtttgtacggccggatttcgtgggttttcaccgtggacaaccgccggggggatgttataatggagttgaacgaaagagggaggcgttatccgtgaagattgtgatcctgggtgcggaggcccgttaccgggcctatcagcccgcgatgcccttcatccagcagcaggagctggtatttctggacaaggacagcacggaggcagagattctggccgccggcgctgatgcggaggtgctgttcgtggacgccatcacggtggtgtccgctgctctgatggaacacatgccctgcctgcggctgattcactcggagggggtggcgtttgaccgcattgacctctccgccgcccgggagcggggcatttacgtctgcaacaacaagggctgcaacgccggggccgtggcggagcagacggtcctgctgatactgatgctcctgcgccatgccctggagggggacgaggccgtccgggcgggacggcagatggagatgaaagagcggtgcatggtggaggggatcacggagctctctgcctgcaaggtgggcctggtaggatttggagacattgcgcgggccgcggcggagcggctggtccccttcggctgcgagctgtactactacaccaagcaccgccgcttgccggaagaggagaaaaaataccacgtcacctacctgccgttggaggagctggcggagaagagcgacatcgtcagcctccactgcgctgtcacggaggagacccggaatctggtggatgccgctctgctgcggcggatgaaacccacagcgtacctcatcaacaccgcccggggagaccttgtggacaacgaggccctgcggcaggccctgctggaggggcgaatcgctggagcggggttggacacgctgtccccggagccggtgccggcggggcaccccctgacggcgctgccgccggaggtccatcggaaagtggtcctggcaccccacctgggcggcattacagaggcatccttccgtcgggcccatgcccacatgtggcgaaatgtggagcatttggctgcgggagagcggccggacaacatcgtcaacggcctgtgatgctcgccgacggtaaaaaattctgccggagatgaaacaaaacctatggaaaaatcgtctaattcctataaagacctatggtagaaggaccatgtgcggtttgaaagtcctgcgcgcgagctgtgggtctgtatgcggaaaaccctcatgcgccaaccggcttgcctgttctcatggcccgcacggcgcatggagtcaggaaaaacaaagaaggggagcgtgacgccgaatgagacgtcggatctggagaggttggatattgtgcctgtgcgcctgcttgctgctgtgcggtgccgccagcgggactggaagcacaccgccggacgcggtgagccgcggggcctttgcagacgccctgtatgacgcccatgtggcccacggcggcgctcctgtggtcagcgagggcagctccgcacccttccgggatgtgggctcctggtctccgtatttcgaggcgctctgttgggctaaggccagcggcatcgcagggggctatgcaggcggtgccttccgtcctgcggcaccggtgacccgccagcaggcgacggtgatgctgtaccgctatgccaagaccacggacctgccgctggagaaggggagcgaccgggatctggccggataccgggacgtggataccatcccaacctggagtcgggaggctgtccaatgggccgtgcggaacggcctgtggttctccggcagcgccacggagctgcaggcggcggagaacgtctcctgggaggagctggccgttctgacccagcggctgttcctgggcgggatgcccgcggctgccttgtctgcggcgccggaggggctgacgatggagctgcagcaatgcactaccaccggcgcggttgtggtactgcaaaatgcggcggaggagaccttctcctatggggcggactacggtctctatcggcaggtgaacggcggctggtatcagatgaacaaggaaatggacaccatcgccattgcctatgagctggccccgggagagagccggaagcttaccctcagctggggagagctggactggggcggcgtcctgcccgccgggacctactgcgtggcgcagggcgggctgctgggagaacagcaggtcaccgtctccgtcacctttgccatcaaataaacgccaggcggccgccgaaaaaccggcggccgcctttccattgggtgaacggtgtcttgcgatcccgcccagaccgaaaaatctccccctcttctggaggagtgaagagaacagcacaggccgccgggaacgcccggcggcctgtacggattcttgagaaggtggcccggcgtcaaacacagaagcggcaggccgccagggccgccacagcgccgtccgcgcaggcggtggtcagctggcggacctccttggcgcggagatcccctgccgcaaagatgccgggaatcggcgtcaggcagtcctccccggcggcgataaagcccgcttcgtccaccggcacccccagagaccgggccagccggctctccggcagcagacccaccgcctggaacagcgcagagaccggcaggtgggagacttctcccacagcggtgttccgcagggtcaggccggtgaggcgttccgatccctccagggcctccaccacggtggaccgcagcagcgtgaggttggcggtcttctccgcccgctccaccagaatgggatccgcccggaagtccgaccgccggtggatcaccgtcacatggcggcagatgtctgccagatacagcgcatcctgcagggcggtgctgccgcctccggccactgccacatcctgtccggcgtaaaaggctccgtcgcacacagcgcagaaggagatgccggccagacgatcctcgcccgcaaggcccagggtccggcgccgcatcccggcggccaggattaccgccccggcggtataggcaccgtagtcggtgaccacccggctgggcgtgccgctctggatctccagcgcctcctccagttcgatccgggtccccagggcctcggcctggctgtacagccgctccgccagttcagcgccggacacggcgggcaggcccggaaagttttccaccttgggagaggaggcgatctgcccgccgaagctctcccgttccagcagcagaacggactttcctgcccggcgggcgtagacggcggcggtgagcccggccgggccgccgcccacgataatgatgtcgaaatactggtccatagatgttcctctctgatgactgacagaagataagggagacttcgcagtcccccgcatagtaaccgctgtaccgcgggtgctgctccgcagagacggcattttggagctcggaaaaggagggacgagagtccctcctttttcgttgtttacacgctctgcgaagtggcgaattttttgatggtggaggcgttcaccagcttctccacctgctctccgtggcggacgatcagggtgggggcctgctggataccgtaccgggccaccagctcccgatgctcgttcacgtccatcacctgataggcgatgcccgccttctccagctcccgctcggcgatgctgcagttggggcaggtcttggtggtgaagaggaacaggccgtcctcgccccactccgccggtgtgctgggcgcggtgccggctgcgggctccgtcgcagcatcccggtcgcagaggcggcggccctccagccgggagttctccacctggtactcctgccggtccttgaactcctggaccttgccgtcgttccagttctggacagggcggtaatagccggtgatgcggctccacacctcgcaggtcttcccacacttggggcaggtaaagtgctcgcccgagagatagccgtggtccggacagatggagtaggtgggggacatggtgtagtaggggagcttgaaattctccgcgatcttccgcaccaaattggcagccgccttccagtccggcagcttctcacccaaaaaggcgtggaacacagtgccggaggtgtacagggtctgcaggtcatcctggatggccagggcctcgaagatgtcgttggtgtagcccaccggcaggtgggaggagttggtgtaataaggcgtgtcaccggggttcttggcagcggtgatgatatcgggatacagtgccacgtcatgcttggccagccggtaggtggtggactcggcgggggtggcctccaggttgtagaggtcgccgtactgctcctgatagtccatcagtcgctcccgcatgtggttcagcacgtccttggcaaaggcctgggtctccggatgggtcaggtccttccgcagccacttggcgttcagacccacctcgttcatgccgatgaggccgatggtggagaagtggttgtcaaaggtgcccaggtagtatttggtgtaggggtacaatcccgcatccatcagcttggtgatgacggtgcgcttcaccttcaggctccgggcggcgatgtccatcatgtggtccagccgctcatagaactcctccggcgtctgggagaggtaggcgatccggggcagattgatagtcaccacgcccacggacccggtggactcgccggagccgaagtagccgccggacttcttccgcagctcccgcagatccagccgcaggcggcagcacatgctgcgcacgtcagaaggctccatgtcagagttgatgtagttggagaaatagggggtgccgtacttggcggtcatctcgaacaggaggcggttgttctccgtgtcggaccagtcaaagtcgcgcgtgatggaataggtggggatgggatactggaagccccggccgtcggcgtcgccctcggtcatgatctcgatgaacgccttgttcaccatatccatttccttcttgcagtcgccgtaagtgaaatcctgctccttgccgcctacgatggccggcaggttctccaggtcacgaggcacggtccagtccagggtgatgttggagaacggcgcctgggtaccccagcgggagggagtgttcacgccgaacacaaaggactggatacactgtttaacctctttctgggagaggttgtccactttcacaaagggggccagataggtgtcaaaggagctgaacgcctgggcgccggcccactcgttctgcatgatgcccaggaagttcaccatctggttgcagagagtggagaggtggctggccggggtggagttgatcttgcccgggatacccaggccctgctggatcagctgcttcaaactccagccggcgcagtagccggtgagcatggagaggtcgtggaggtggatggcgccgctcttgtgggcgtcggcaatctcctggtcatagatttcagagagccagtagttggcggtgatggcgccggagttggagaggatcaggccgcccacggagtaggtgacggtggagttctccttcacccgccagtcgttgatatgcaggtagttgtccaccagctccttgtagtccagcatggtggagttcaggttgcggatcttctcccgctgcttgcggtagagaatgtaggccttggccacgtcggcatagcctgccttgctgagaatgtcctccacgctgtcctgaatgtcttccacggtgatcttgccgtcatggatcttatcctggtaatccgccgtgaccctcagggccaggagatcaatgatgtccggattgtactccatgtgggtggcctcaaaggccttggtgatggcggtgctgatcttggagatgtcgaaagaggcgatctttccatcccgcttgacaacctgatacatgaaacccctgctttctctatgataaattcaattccctgctcctgacaagtcaatgggcgctgacgcgccccgtatttcccattctaccacttcctgggggcttgtcaattagaaatgccactatatcttgtatgcattttctgtgaaaacgctgaatttttccatatctagtcaatgccgcgcagctccacagctccaaagaacggccggacccgctccgcaaagccctgcagctgctctgctgtaaagccgtgatatccccggccgatcagattgccggagtccacaaagttctgaagatagtaccggggtgcccctgccagccaggcggcgatggcgtccaggtcctccggcctgtggagctcccgcaccagggtggtgcggaactcatagtccacggtgcttttccgcagcagacggatgctctcctccaccggggcggggttgaagcccggtatgccgacggtttcggcataccgcgccggagcgtttttcacgtccatggccacatagtccacaaggccctggttcaggatctccgccagccgggcaggatcacagccgttggtatccagcttcacggcaaagcccagttcccgcaccttccgcagaaaatccgctgcgtccggctggagcagcggctccccgccggtgaggaccaccccgtccaaaagcccccggcgggaggccaggaagtccagcacctcctgctccgggatctccggcgtctccgccagccgggtcaccagcaatgcgttgtggcagaaggggcaccgcaggttgcagccgccggtgaacaccgtggccgccagctttcccgggtagtccaccatggccagtttctgaagtccgtgaatgtgcatggccggatccctccataagcacaagatgttgctattctaaactgatttttccacaagaacaagtggtggacgcaacaaagacaaaaaagttcccggaggcagagcctccgggaacgggaaagacgggattcaattcttgcggaaccgggagaggaagtcctgcgtctcctgtttctggggattgccgaaaacctgctccggcgtgccctcctcgcagatgacgccctggttcatgtacaccacatggctgctgacgtcccgggcaaaggccatctcatgagtcaccaccagcatggtcatgccctcctgggccaggtcctgcatgacggagaggacttctcccaccatctccgggtccagggcggaggtgggttcgtcgaacagcagcacctccggctccatggccagggcccgggcaatggccacccgctgcttctggccgccggagatctgccggggcttggcttggatgtaaggcgccatgcccaccttttccagatactccatggcccgcttccgggcggtctccttgtcctttttcagtaccttgatctgcccgaccatgcaattttccagcacggtcatgttgttgaacaggttgaaggactggaacaccatgcccacatgggagcggtactgggggcattgaccttgggaccggtgacgttctggccgcggtagaggatctcgccgctggtgggggtctccagcaggttgatgcaccgcagcagggtgctcttgccggagccggaggcaccaatgatgctggtgacatcgccttttttcacggtgaaatcgatgtcccgcagcacttcgtggctgccgaaggacttgctcagatgccggatctctaaaatcatatcgtccatgttgtcagcgatctcctctcgtacggccgtgctgcaattcctgacggacccgatcccggtactctttgctccgctcatcgaagggagtgccccggtccgggtggctgtatgtgccggcggccatggtcagatggtccgtctgtgccagcttgtaatcgctgctgccgtccattcgcttttccaaccagcgcagcaggaaggaggcgatcagcgtcatggtgaggtacccggccatctccaccacggcggaggggaagtacaggtagctggcgcccaccgccgcccggtgggcggagaagaaatcggggaagccgatgatgaacatgacggacgtatccttcacattgatgatgaagttgttgccgatctggggcaggatattccggatggcctgaggcaggatcacatgcagcatggtctgcacatgggtcatgccgatggccttggcgccctcggtctggccggggtcgatggagataatgccgccccggacggactcggccatgtaggcgccggtgttgatggacaccaccagaatggcggccatccagatgctgtcaaaccgcacggcgttgtccgtaaaatagggcaggccgtaatagaggaacaccgcctgcagcaccatgggggtaccccggaagatctccacgtagatccggaccactgcccggatcagcgccagaaagaaccgcttgacgggcggggcgttcttgctgtggggaatggtgttcagaatgccgcagacgaatccgatcaggcagccgatggcggtggccaccagtgccagaatcaaggtattgcggatgccgggcagatagtgggacacgccgtagttcgaccagagcttggcaatgtcggatgccagctggaacagtttctccatggaggcagactcccttcggtaaagagttgatatgcgggaagcaggcgggaggacagactgtcctcccgccgcgggtcattctggaaagtgtttactcgctcaggggctgaatggcgatggcctcgttcatcagggtgttgaaatcgtccgccgtcatagtggagagcacgctgtcaatggcctccttcagctcggtgttgcccttcatcacggagatgccgatgttgatctcgccctcgtcaacctcaaagttgtcgtcggagtctgtgaagtccagaatcttcatgtcgggataggcggccacggcacccatagcggtgggcatatcggtgcagatgaagtccacggcgtcggtctccagggccatcagcatggcgggggcggtctccgcggcagtctggacctgggcgccctcgatctgaggcaggcaggagtcataccagatggtggcgatctgcgcggtgcaggtgccgccggaaaggtcgctgatgccggcggcgttggcataggggctgtccgtcttggtcacacagacgatggaggcgtagtagtaggggccggcgaaatccacctgctcgctgcgctcggcagtcatggactggccggcaatgacggcgtcaaaggtaccggtctgcacgccgggaaccagagagtcccagtcggactgaaccacttccagcttccagccgttggcctcgcagatctgcttggcgatcatcacgtcgtagccgttggcataggtgccgggcacgttggagatgggcacagcgccgttggagtcgtcgctctgactccagttgtaaggggcgtaggcgcactccatggcgatggtcagcacgccgtcctccacgccggaggagccggcggtctccccgccttcagcggtggtgccggaattgccggagtcggcagtgtcgccggagctgccggtgccgccgcaggcggccagggacgctgtcatggccagagccatcagcaaggtcaacaatctcttcatgtttcttcacctttctcatctcaaaaaagattccgcggcggtcacagacctcctccgcgcctgccgccggcggagaggagaaaaaatggaccgctttgtcaagcggtccatggaaaatacggaaagaagcccccggcagggacgatcccgaacagccattgatagcgcttcacaaaggtttgtgacagtccggcaggtattccctgacggcccagcaccagaaggacaggcatcgtcccggcacttcggcggcggacccttccccgtccggcggctgcctggccttgccggagcggtactgatgaacgccgcgcctctatctgagcgatccaattttgaaggtatcctatcacgttctcggggagatgtcaacgccccttcccagaaaaatgccaaaaatcccgcagatttgtgcagatcatagaagaaaatgccaaaaccgttgcgcactgtggggaaaatgtggtatgatgctccctgcacacacggcgcaagcgccgggagaggagtgtggaagtatgatgcaggcggcggaactggcggtgctggactggctccaggcccatctgcgctgcgattttctggacgcggtgatgccgtggatcagccggatctgcgaccacggagagatttggatcctgctggcggcggtgctgctgcttctgtggaagcaccgctggacagggatgtccctgtcctttgcgctgattctggatctgatctgctgcaatatcgttctgaaacccctggtcggccgggtccggcccttcttggtgaataccgcggtggagctgctgacagcacccccggcggacgcatcctttccctcggggcacacggcggcgtcctttgcggcggtgttcgccctccgggcctccggcagccccctgtggaagcctgccctggtactggcggctgggatcgccttctcccggctgtacctgtacgtccactggcccaccgacgtgctggggggcattctggtgggcgccgccgcaggctgggcaggcgcgcggctggcagacgccctccgccgcaggcgggagcggctgggccgcagggcatagcggaaaaaacggaccggacggcttgccgtccggtccgtgcggcttcacgcggcgttctccctggcctgaagatatttcttcacagcgaagatgcccgccaccgctgccacgcccagtagcgtctccgccgcgtcggtgtggctgacgatcatctgccggacgatggtgaacagcagcacgtccaccaccgcgtcggcggtgtgcagggccagcatcttcacgaactcaattcccatcaccagcagcagtgtggcggagaggaaatcccccagggcgaaggcctctggggagaggagcagggtccggccagtctcccggaacaaaaataccgccccgcagacgatcaccagcaggatcacggcggcgatgagcagctccaaagcacgggcggccttcaacaacaggatgtgggcgggatgacggttcatggtgcctccttgcgccgcggggcggcagaatgaagataagaaataaaaagggggataagagatgcccctctccgggaagtatctcttattcttttatctgggccttggacttgcaaaaacgaagagctcgtaaaaatgtaggggcggcaatctgccgcccggcgggaatagtgtgggggcgtcgtgttacccctcgtcgatgtcgaggctgccgacgggagccccggagggcagaaatttttcgccgtcggacactgtcaggtacataaagcctgtggaatccgctgattggtacaccagcgtacggtcctcgacggcaaagcggttgacgaatttttcatcatctgtggtgaggatcacggtgtctccgtccagtttccaggtgccgagcccaaaatagctgctcagggctccttcggaacatcgcatacttccgtcactgttgagggcgatatagaaatcgctcccaaacccctctttttcgtagatgtagacctggtcggcgaggtcgtcggcggttaccgctgccggctggccggaacagcccgccgccatgagagtaaagagcaggagcagggcggaaaacagacggcacttcatcatgatgtagccctcctttccatgatccgaaaacaggaccgcctctccatcaatctatcacagacggcggcccattgcaaggcaaacccgccttgcgtaaacgccggatttgggatatactatatctctatggaaaaatcagcctgcgggcaggaggaactccccatgaagctcatggtcatcgacggcaacagcatcctgaatcgggcctattacggcatccgtcctctcaccacacgggacgggctttacacccacgccatcttcggatttctcaccacgctccttcgactggagggggaggaggcaccggacgcgttgtgcgtcaccttcgacgtccacgctccaaccttccgccatcaggcgtcggaggcctacaaggccacccgcaagcccatgccggaggagctccgggtccaggtgccggtgctgaaagaggtgctggacgccctgaacattccccgttatgagcaggagggctgggaggccgatgacctgatcggcaccatctcccgcaagtgcgaggcggacggctgggactgcgtggtggtcaccggcgacaaggacagcctgcagctcattaccgaccacaccatggtgaagctggtgtccacccgcatggggcagaccaccaccaaggatatgacggagaccgccttccaagagcagtacggcttcgcccccatccacatgatcgacctgaaggccctgatgggggacagctccgacaacatccccggcgtccccggcatcggggagaagaccgccatggccctgatccagcagtacgagagcatcgacaacctgtacgccaaaatgccggacatcgaggccaagcctgccgccatccgcaagctggcggagggggaggagagcgcccgggagtcttactggctggccaccatcgttaccgacgcgcctctggacttccatcccgaggagaacctgtgccggaagcccggcccggacgcctacccgctgtttttgaagctggagttcaccaagctgatcgagaagttcggcctgtccccggcggagcagccagcggcggaaagggcggacttcaccatgaccgtggagcaggtcacagagcctgctcagacggagcggctgctggccctctggcgagcggcggaccatgtatcggtgctggccctgccggacctgacgggcctctctgtggtctgccggaccggggcggacaccggcgtcacggcggagctgttcttcgacaagtatcagggggactggaacgcccttttgaacgccctgttcgcggcggacgtccgcaaggtctcccacaatgtcaaggacctgacgcggacgctgctggaaaacggcctgcgggcggagggcttcgtcttcgacaccgccctggctgcctacctgctggacgccacggcggggagctatgaccttgcccgcctgttcgtcgcctatttcaacgaggagctgccaaaggccctctacctggaaccggacgccttctccctgctgggggacgccgccgcggcggaggccagcttcgacagctacgccgccgccgtggactccctgtacggcgccctggcggaaagactggcggagcggggccagatggacctgctgcatgagatcgagatgcccctctgcgccgtgctggcggagatggagaccgccggatgcagggtagacgccaaggccctcggtgctttcggggatctgctggcccggcggagcgccgagctggaacagcagatctacgccatggcgggggaggaattcaacatcaactcccccaagcagctgggggagatcctcttcggcaagctgggcctgccccatggcaaaaagaccaagaccggctggtccaccaacgccgatgtgctggaaaagctccggtacgaggcccccatcgtgggggcggtgctggagtatcgccagtacgccaagctgaaatccacctatgccgacggccttttgaaggccatggacccggacggccgggtgcggaccagcttccagatgacggtgacggccacgggccgcctctcctccacagagcctaatctccagaacatccccacccgcacggacctgggcagcgagatccggcggatgttcatcccggcggagggctgcgtcctagtggacgccgactactcccagatcgagctgcggctgctggcccacatggctggggacgaggccatgatcgccgccttccgctccggcggggacttccacgcggagacggcggccaaggtgttccacgtggcgccggaccaggtaactcatgagatgcgccgccaggccaaggcagtgaacttcggcatcgtctacggcatctccgccttctctctgagccaggacatcggcgtgagcgtggcggaggccaaggcgtatatggaggcctacttcgccaccttcccaggcgtccggacgtatatggacgccattgtggagcgggccagggagcagggctatgtggagacgctgttccaccggcggcgggacctgccggagctgaagtcctccaacttcaacctccgctccttcggggagcgagtggccctgaacatgcccatccagggcaccgcggcggacatcatgaagctggctatggtggcggtgcggaaacgcctgcggcaggaactgccggaggcccgtctggtgctgcaagtccacgacgagctgatcgtggagtgcccggaggcccaggcggagaccgccgcggcgctgctgaaggaggagatggagaacgtggtgtccctctccgtccccctaacggcggacgcccactggggcagaaactggctggaggccaagggctgatgggatttcagaagatcgactacgccgcgtggccccgccgtccgtattttgagcattaccaccgggacgtgccctgttggtacagcatgacggtggacgtggacatctccgccctactgccccgcctgcgggggtcgggactccggttctatccgtcggtgatccacggcatctcccggatggtcaacgcggacccggccctccgcatggctatggacgagacgggggccatcggcgtctacgaccgggtggaccccacttatacgatttttcacaaggacgatgagaccttctccgtcctctggaccgcctaccagccggatctgcgggccttctgccaggactgggaggcggaccggacccgctatggggacatccacacctttgaagcccgcccgccggaggcgggacagggactcttcaacatctccgccgtgccctgggcctccttccgaagtctgcacctggagctgccggaggccaacgactacctgctgcccatcttcaccctgggccgctaccggaaggagaacggccgcaccctgctgcctctggccatgcaggtccaccacggcgtcacggacggctttcacgtggggcggttcttcaaccgcctccaggcctgggcggacagtgcgccggagatgggcgcatgaagcgcctgtatatgatcggcggtcctatgggcgtgggaaagaccgccgcctgccgccagctgcagcagctgctggaccggagcgtgttcctggacggggactggtgctgggatgcccacccctttcaggtgacggaggagacccgggagatggtgttggagaacatctcttttctcctgaacagcttcctccgctgctccgcctatgaccatgtgattttctgctgggtcctgcaccggcgggaaatctgggaagacctgctccgccgcctgacggagccgtatgtcctgcgggccgtctccctggtctgcacaccggagaccctgcggtcccggctggagggagatatcctcgccggaaagcgaataccggatgtgttggaccggagcctggcctacctgccgctgtatgatgccctggacatccggcacctggatgtgacggctttgacgccccgggagacggcggagtgcatccgaagggagggcggcgcatgaagcggctgatcgtcctgctgggcgtggctggggtgtccctgtcggcggtgtttgtccggtggtccacggcgccgtccctgatcctggcgctgtaccggatggccttttcggcggcgctgatggcggtcccggtactggcgggacgaaggcgggagctgaaatccctgacccggcgggacgtgctgctgtgccttgccagcggcttgtttctgggcatccacttcgcggcgtattttggggccctgcgggccacctccatcgcctcggcggtggtgctggtggatacggaggtattctttgtggcagcggcctcggcgttgtttctggggcagcggctgccccgccggacctggcccgcggtcctgcttgcctttgcaggcagcgcggtggtggcgctggcagacagcgccgccgggacgaatgcgctgctgggagatttgattgccctggccggcgccgccgccatggcggtctataccatgatcggaacggtctgccggcagcggctctccacgtcagtgtacacctttctggtgtatacgtccgccgcggccacgctgctggctgcggccctgctgagcggaacgccgctggccggctacggtccggtgaacgggctgacggccctgggcatggcggtatgctgcaccctgctgggacacaatgtgttcagctgggggctgaaatatctgccgccggccttcatcgccacggtcaagctgatggagccggtgttcgcctctgtctggggactcctgctctttggcgagcggccgggctggctgacggttgccggaggcgcggcggtccttctgggcgtggggctgtatgcccgtaccatcggcggggatgccggaaaacgagaggagagagaaccatgagagaacagatgcacgtgcgcatcgtccccatgaccggggaccatctggacgaggtggcggagctggaacggatctgcttcaccaccccctggtcccggaacatgctggtggaggagctgcagaacgactgcgccgccttcctggtggccctggatgacgaggaccacgtggcgggctacgccggcctgctggtggtgctggacgaggggtacatcaccaatgtggccgtgcggccggagtgccgccgcaacggcatcgcccagaagctgctgcaagtgttcctggactttgcccaggcccacaagctggcgtttctgacgctggaggtccgggcctccaactacggggccatcgccctgtacggcagccggggcttccgcagcgtgggcaggcggaaaaactattacgagcatccgaaggaggatgccatcatcatgacaaaggagtttaccgatggaactgaggatcccgacactggagcagctgcggacggtctatgaccgggacctgcggacagcatttcccgcagcggagctgaagcccctgaagaatatggaggagatgtgggccgaggggcggtaccgcccctggtgcctctttgacggggacgacatcgccggcgaggcatttttatggctgggccaccccggctgggccctgctggactatctgtgcgtggccgcagaccgccggaacggcggcctgggctccgtgatcctggagaagctccgggaggcggagcggggcaatgtgatcttcggagagagtgagatcccttgctacgccccggacccggccatggcagagcggcggctgggcttctatgcccgcaacggcgcccggaccgccgggtatgacacggagatgttcggcgtaccctacaagaccctgtactgggcggaggggaaagtggacgagtccgccctgatggaggagcaccgctttatctatgccagtacctttgcgccggataaattccgcagatatgtccgcatcccctttgatccaaatgggacgccgggcgagagagtatcctggcagcagtgacggaaaagagagggacagatcatgaaaattttggcctttgagtcctcctgcgacgagacagcggtggccgtggtggaggacgggcgcacggtcctgtccgatgccatcgcctcccaggcggacctccacgccctgtacggcggcgtggtgccggagatcgcctcccgcaagcatgtggaggccattgccgccctgacggaccaggctctgcggcaggcgggctgtgagaagtccgacatcgacgcggtggcagtgacctatgccccggggctcatcggcgcggtgctggtgggcctcagcttcgccaagtcggtggcctttgccctgggggtgcccctgatcccggtgcaccacatccggggccacatcgccgccaattacctggcctttccggaactggagccgcccttcctggccctggccatctccggaggcaacacaatgatcgtggacgtccgggactacacggatatggagattctgggcgccacccgggatgacgcagcaggggagtgcttcgacaaggcggcccgggtgctgggcctgccctatcccggcggcgcccccatggacgccctggcccggcagtccccgggcggggtgtacaccctgcctcacgcccatgtggacggggcagagctggacatgagcttctccggcctcaagacggcggtggtgaacctggcccaccatgctcagcaggtgggggagtctctggaccgggcagcgctggctcgggacttcgcccaggctgtcagcgatacactggtgccccgggccatggaggcggcaaagcagactggccgcactgtgctttgcgccgccggcggcgtagcggccaactccgtcatccgggaggatcttcgtcgggcctgcgaggcggcagacatccggttatacctgccgccgctgaaactctgcggcgacaacggtgccatgatcggcgcccaggggtattatgaatatctggcagggcatacggctggcatggagctgaacgcctatgctacacgggacattgcagactgaatcaggcggccgcgtcagcggccgcctgatttattggaaaatgcataacgagcttatgcaggctgcatctgtaaagccagataccttgctttttgtgaaggcgcagctcgggtggtcttcatttgccgttcacttttggaaaaacaggcaggagagacggagaagtttttgaaggcaaaacattatgtaaagtttagacgcttttttgggcggtggaaaagcgcaaaaagagaagatggtaaatttatacaatttacaaaaaaatattgaaaataaatagaaaattcgcgtgtggaaaatcatgtggaaaatgtgaataactctttgtaaaaagaaattatcaaataaattatgtaaatgctgaaaagaacggaagactgcaaaaagaagggagtcaacagaaaataatgacagaatttgtcgaagtttcttgggaaaatcacaacagaatttcctgttgtaatgggcggaattcgggggaaaagcgtaggaaataggctaatcgcctgaaaatattttgaaggaattccttcaaaatacaaaatgtaatatacaggaattgccatgcagagggtgtggcaggaaatcaaaagaatctgttgacgtcggtcaaaaaatatgataaaatatatcctgttctggatgtgcctttccaaaaacaccatgtcatgaattgataagctaatgtagctcagtcggtagagcagctgattcgtaatcagcaggtcgtgtgttcgagtcacatcattagctccaaaagaagccctgaggtccaacggccttggggcttctctttttctggaaatgttgtataacggtggtaatgtggtagcaactgtcatttagcttgtgcatctccggctggaggcggcccggatcgttgttattgatgagcgcagaacctgtgctgcctaaggcatctgcgcgcactggcggcaggccggggctggtgaacgagaaccccgaccatgtgcggcctgcatactgccagagggcctctcggagggaggatgcccctgtgagcggctggagcagagaaattcaaaacgcaaagaggagacggaagaccgtgtggcttccttcgagcgaaagagggccccggtgcggaatctgcaccggggcccatgaggttctcaatgtccgtttcgaccggaagctccacggctttgcgcgtgcttcctgccgcgctccgccgggaatccatgcaccttacttataataaattcccaatagcgccttatgaggctctgtgaatgcccccagccggatctccatgctgatctcgaaggcccggtcccaggggaagccgtatcccgtcagctccacgccgccccagccccgctcggcatactcccgggtggcggaaagggaagagatgaagttgctccgctccaggttttcgatcaccggggccacggccgctgccatgccggcctccagccgctccaggatggacacccggtcgatgtccggcatccagaagttgtcggcattgcccgacaggtcgttccggacaaagctcagaatgtcgttgcgcacgatgttcttgtagcagaagtccttcagaatgctgtccgccaaggtccggagaaatgcctgttctgtggcatctgtttgctcaccgtgctggaggaaggcataccgggccacaccatggctcagggccgtgccggtgacgatggccatatccagaaaacccgcatagctcaaaagccagccaagctctgcctgatctgtcagcgccttatggaaggcggtcccgtaggtgccgtttcccgcgtcgatgaggatggtaggcagcccggcagcccggttgtcgttcagacactggaccagtgcgttgatatacgtctcctgggctgccgggtctgccggctgggtcagcaccagcattgccagttcctcgccgccgggttccgccatcgtcaggtcgaaaaagtcgaagtgctctgccacgatggcctccagaggctggtagtcataggcgcaggcaggccggtcctcagtaccgccgaaatactggacggataccgcggcaccctcccagccccactcctccaggcagagcttcgtcaccgccttaaaggccaggtcgtccacaccggagagcagggcgtccccttggcgcagctgcgcccggagataggcgatctcgtttttctggatgctgtcctcctccgaggagtcgtcgatgccgatcaatacccggaactgcccgtccgccgtctcctccagagcttggaacatggcgtcgctaagccgcagcttccgctcccgggaggccagatagttctccacggctccctccggcagcggctcctccgcctccaccgggacgggggttccgtccgcccccagggggtagtccgccacaatgttcccgatggtcagatccgtgccctccaggtggggacggggtgccatgccgtaagtccgcagggcattgtactcgttgaggccgaacccgccgtagccggtggtggccgccagccgcatgactgtgtccagcaaccagatccggttgttctcatccgctgccagcaggtcgatcaccgccgtcagcagctccgcttccaccagtgtctctccggaggaaagcgtcaccgggttctccccagtcatagcccgggagctgaccagcccgccggagagcagctgatccagggacaggatgtaccggtcacacccggcggcctcctgcttagccacccactcgtacagtgctccccggtccccgtactgggtcccgttctcattcgggggctggccgtccagccgggtgcggtacaggtcccgctccggcatggccaactcgtagcccaaggattccgccaggtataccacccgctcggcgttgtctggccggtcatccagaggtacgtaggcgatcaccggcgcaccggcccggggggtctcctgttccacaggctccgtccgcaccggcccgcaccctgccagaagcgtacaggccagcgccgctgccaacatccgtcttctcatggtatgttctcctgtttccaaaagagcggagccatcggctccgctccatctgttctgtcctgccccacactctcgggacgggaaaaggggcaggggaaaaccttcggttttccccagttgatctgcctccggcagctcaagaatctgaaaccattttcggcaggatatgcgcctgccgaaaatacatggactcagccgccttgggcggcgtctccagtgaccgccgtggtggctcggaggggagcctgctcccctccgaattccctcacagtccgaatgctcccaggtccaacccaccggtggcctgctcgatgctcttgtccatggcctccccggcctggcgcagggcctcatttacagcggataccaccaggtcctggagcatctccacatcctccgggtccacggcctccggtttgatggtaacggccagcacttcctttttgccgttgaccttggcctctaccacgccgcctcccacgctggcggtgaactcctgggcctctacggcctcctgggccgcattcacctgctcctgcatctgctggatgcgggcctgcatctccgcctggcgctgagcgccggtcatcttcatgctgccgttggtaaatccacggcgtgcgctgtatcccataactggtctctcctttgtattacttgatctcgatattatcgaactgactgccgaatttcagcaggttctgcagattttcccggggcgtggccttggggggctctcccacctgaaagaccaggcgcaccgtcacgccgccgctggcggcttcctccatcagggcatttcgcacccggtcattgtccagacgtcccaaggtaatgtcatccggggcataaaccgtcagcaggccgccctccagaacacctgtgcacatatccagaaacacccggtacataggcggcaggcggcccttgcaaccctctgccagcgcccgccaccaactgccccccacagcggatgccgcagcaggggagggggcggcgggctgcgcctccggtacgtcgaacacccgcgctccgggctcctccggcagaggcggctcctcgggaagcggagggcgctcctcccgtgccggcggttcttcccgaggcggggcatcctccggcgcaggtgccgggggcggtacggggccggaggacagcttcaccgtgccgccgctttctgcggcggccgcccgcagaagctgcccccgttgggcactgtcttccagccgctggacccgggcctccagggccgtcaggtcccagagagggactcgtcgcacagccgcaggaggcagagctccgcatccgtgcggcggttggagctgtaatagaggtccgccgtggccctttgcagcgtagtggccaggtagatcagccgggtagcgggaatctccctgcccagcctgtccagcgtggcgctgtcatagccgccggagagcagggctgccccccctccggcgctgtacgtcgcagcagcaggtcccggaccagcgtgctgagctcacccagcaccgcgcctacatccttgccaccctggtacagctggtccagctgcagcagggcgcccttggcgtcccggctcagaataaactccatcagctgggccgtctgcaggtttcccgccaggcccagcgcctccagcacggcccggctgtccacggttccgcctacggcggcacactggtccaaaaggctcaggccgtcccgcagagcgccgtccgccagacggctcaacagctccgcgccatccgccgtcaggtcgatctgctcctgtccggccacatacagcagccgcgccgcgatgtcctgaggcgtgatgcgcttgaaggaaaaccgctggcaccgggagaggatggtggcgggcaccttgtggagctccgtagtggccagaatgaacatcaggtgctccggcggctcctccagaatcttcagcagagcattgaaggccggggtggagagcatgtggacctcgtccacgatgtacacccgcttcttcacattggccggggcgtagatggcttcgtcccgcaaggcccgcacctggtcgacaccgttgttggaggcagcgtccagctccagtacatccagaaaactgccgttttcgatgcccacgcaggaggggcactggcagcagggatcgccgtccatcgggtgctcgcagttgacggccttggccaagattttggcacaggtggtcttgccggtgccccgggtgcctgtgaagaggtacgcatgggaggtgcggccctccgccacctgcttacgcagagtctgggtgatgtgggactggccgatgacatccgaaaacgttttgggccgccatttgcggtacagggcctgatacaagaaatcacctccaagcgaaaaaagtcctccgcatgcagctgcggaaccggcgccctcgcggcacatggaacatcccgcttaatgctgctcggttccccgcctgacatgattcgcgggcatccattgcgcgagaccggctccgcagctgcatgcggaggactgtaacgttatagcttatttattttactatatcctctgcaaattggcaacaaaaaattttccgctttctgaaaaaaatagtctttacaacagagaaaattatggtataatattatctgccgttgcatgacaggaatgatggactcatagttcaacggggagggcgctgcgtttgcagccatataaaactacatcccgcagcgctggttctcttcccattcactagtctggttttccatgattttccctcaaaatcgaatatcctgaaaatccgtttttcataacttttttcgatggaaaatggccaatatgggcccatagctcagctgggagagcgtacggttcgcatccgtaaggtcgtcggttcgatcccgattgggtccaccaaatgaatgaccccacccaatttgaacaaacgcttgtcgttgttcagaacgggtggggtcattttatgcctgaactccttgcattgcaaggggttcaggcctttctgtatttcatgtcttgtgtcacctgaaaaatacaaacagggtaaaatcaaaacacaaaacgtgtaatcgacgagattcgaacccctgttatgtcagtaagttgctctcctcatttgccgttcatgaacaactcttctacctgacaaggtgttcggtttttcaatgtgcgatgtggccgctgtgtgttgtaaaactcgatataagatgcaaggcatcgtttgaaatctgtttcggaagtgtagtccttcctgtaaagctcctcctttttgagtgtagcgaagaacgattcagcaacagcgttgtcatgaggccgccctgaattggagaaagattgtaccacagcgtgctcatgtagtagctgtttgaatcgatgcgaggtgtattgagcacctcggtcactgtgaaagatgagttttgtttctgggtttctttgtgcccatgccattttgaaagtagatgtgatcaactgggtgctgttctttctggatactttgtatgcgacaattttgcgggaaaacaaatccaaaatcacacaggtgtaaagatagaactcccccagcttaaaacaagtaacatcgctgacccagatttggttgggcttgtccgcctgaaactgctgctggaggatgttccgtttcttttccggttcatgaagtttcatgtagtcctgttttgcagtgctgcggatactagctaggcccatctctctcatcagttttgccacatattctgtgctgacttgatggccatgttggacaagtattgtgcggatcttttcagcacccagcacctggcggtactcatcaaatatcttctgaatcagaatacgatattcctcccgccgcttttcgaaccaagcgttgctccgtttatttcggagaatgtggttatagaaagtcccgcggggaacattcagagcttcacaaagtgtatggacatcatattggccgtacagtaattctagctccgtcagtcgctccttcaacggagcatggacggtgcagccgacggtttgcaaaacggcgaccatgttttccaatttagagactttgtgtagaagtgcatcatactctttgacggtgcaggtgcgtctttcatcgggaaccgctgggcagtatagttttgcccagcgatagatcgtccgtacgcagacactgtattctgcgcataattcctggattggcttgccctgcctgtactgtgcgatgatatcggttttctcttgatctgtgtaggtcatgatgtttgcccctttcttgtaatatgctactagtgtagcatgtagaaaaagattaacacgaagagaggccgcctgccctgctaacaatacttgagcctggtattgacaaaggaattattataatcagtctattttataaaaagcaaacttcaagaactggtcaaggaattggactgactgctttggtgtcagggagtgaagttgtgaacctgcaaatcaaggatatcatcaatgaaatacgccctgttgtgataaataaaaagcgtacagaactggatgcccggcacgatataggccgagaaaacaaagtcacggaaatcatggaactcatttctacaaaaaatatcgaccttatggagtatttggaatccatgttatatagggtgattcagcgagtaagcatgctctccaaagaaaaattttcatccgattcgtctgtagttttgaaatcacccatctccttactaagaagcaggcacagaaaaatgtggacagcttgggtgctgcctgtgtctctctgtgcctgcttttttgttgagaagtggaaaaattgtgatataatataaaaataaaagaacattagattggcatgagctgaaaatgaatgcgagatgagaatatgtcatacactgtaaaatcatctgaaagattaaggaaatctggttcagaggcagaaaccaaggcattgctttatttaatgaatttcagacccgatagtgatgacatatactactttgttgtagatttctttaatgacttaactgggatggacaacatggcatccagattgtgggatgtgcaatcaaaaggcgcacatcatgttagtcccaaagctatcgggaaagaacttgtcacattgttcaagaattatatgagcccattaacctttgaggcatatattctatttattggcagtgtgaccggatctcttcgcaaagattcttctcttacaacttttgggattgaaaatgtaaaggatgcagcgatagaacagattaagttaggcttacatgaagaaggttccgcaaaagaatatattgatagcaccgacttgaccgatgagaacattaatggtttcctgagaaaagtgttttttgtcattgatgatggtaaaaaaccaagtgaatatgtaaaagcaattataaggcaacatccgaatattattccagaagaaaaaatacttaacgctatttttaatgagataagagataaacaggcaagcaaaaaaaatatttcttcagtcgaggggattgtgattgaaacgactgatgaagcgttaaactattgcaggcacttaactaataatgaaattcgtttaatgactttacagcgtattatcaatagagatccgctgggtcaaggaataccaccatcttttgtaagtatctataatacttggccaccagaaaggcagagggaaatgctcgaagattgccaaggtgccttatgtagggcattattcaataaaaatgcggcagatggtttttggtatctatttgagaatacatatcaactgattgtcgaacatccagatgactctgtgcagtctctatttacaaaaattcaggcaatacctaattgtattgttcggtgtcctgactttgacgccctatcacttaagtactttatctctgtagtcaaggatggtgttcaacaatgaagatacggaaagtagctgtaggaaatgctgctgaagcatttattgaaggaaatttcacaaatggtgtgaacatcatttcgagcgacgataataataagggaaagacgattgtaatccaatcaatgatgtatgctttaggaaatgaaccaacattccctacatcatttgaatttcagaagtattattactatatcgaatttgaagaagctgggattatattcaaactttgccgatctggcgatggatttgtattaaagcgtgaatctactgtacttatttttgataatgtttctgaacttaaaagatattggaacaggaatatatttccacttccgtcaatagcaaaaaatcaacttttaaggattgtagatccagtactatatgtccagcttttctttattggacaagataagaaggacacgtccaatatcgccaatcacggcttctataataaacaagattttatcgatatgctttacgcatatgctggtttaattggagagcaacttccacaagagaggattgatgagataaagagtcatataataactctttctgacgagaaaaagctattgctacaacaacataaaatacttaaatcgaaaaaaacacctgtttcatatcttagcgcggagagtgaccgcctcgcatttggtaaaaaaatagagagtcttgaaagagtccaaaataaaattgcggaattacggaaggctcgtaatagtgtatctactcgtaagagtaaatgggagcatacgattaacgaacttcgctctttaaatcgcacaatatcgtgtggagaattacgatgcatggattgcaactctacaaatatctcgtttagtactggagagtcagttcaaacatcctactcgtttgatgtgtctacagttgaaatgcgaaatgaaatcattcattctatttcagaaaaaatttctgcttatagcgaagaaattgaacggctttctgcagaaataattatagagcaagaacgtttgcaatctttaatggatgatgaaagcgtctctcttgaatctattgtcgcttacaagaaagatattttttcggcttcagatgcagaagccagaattaaagagatagacatggaagtcgctacattaaagagtcaactgttagccagtgaaaatgcatcgattgaaacgcaagagcaaagagtagctttgttatcagcaattataggcaaaatgaatgaactttaccatcagattgatccggatggtaatataatatattcaagcttatttactcagcgaaatgaggtgtattctggaagcgaggcgactatttttcatgtggtgaaattgtttgccttacaatttgtgttgcggcacagtttcccaatagtaattgactccttccgagcagaagacttatcgactggaaaagaaaatacggtgcttgaaatctcaaaatcaattgataagcaagtaatactgacaacaacattaaagcatgaagagataggaaaatatgacgaccttccagatgtgaatcatataaattatcaatctcatactccaagcaagatccttgatggtgcttttgtagaatcctttgttgcattgttgaatgacctttcgattgagatttaaatggggtataaaaagtattgactcactatattagatcgccccttgcgctagcttttcatatcatattatttttgggggaaaaggtgactacgcctcacttccacaccggccccgctacgctaggccctagtttggagttggtgcagactgcatctttttgtctacacattccattgtagacaaagcctgcgtttaacgatagttatacgcaggttttgtttttacttggcgatatagcacaaaatggcgagatacaaattagttataattacatatcacatgtgtcaacaagcaggtttaaggaaaaggtatcttccttaaacctgcttttatttatgttttaaaaagtgaggcaactatgaaacttccatatggctatgttttgattggcaaggaaatcgttattcatgaagaaaaggcggatgttgtccgtagcatttttgatgattaccttgccggagccagcttaggcaagattgttgatctgcttttcaaaaaaggggtggtttctccaactggaaaagtaaaatggacgagggcggccgtggataaacttctggcgaacaaaaaatatatccccctggttggtattaagatatacatggatactcagtttgagaaagctcgacgttgcaatgtagactatgataaagccgggtatccacgaaaggcagtcaggtatcagtctccagtttttgatacaaaatgagactatacagaacccatttctcttgttatactaaataaaaaggagaatgggccatgaacgagaatgaactacatgagcgatacatacgcttggcatttcaatatgagtctgccattgatgcccttctgacaaaaggattggtcgatatagaagcggccgacgccgcaaaagagagattctatgatacattgaatgaggaaaagctgcggaccacacaaaaaatcagggactatcatgagaccatcagcctgtatatgaggatgctggcctatgatggcatggtctccctgacagaattggcaaggcagtattccgatgagtcgccgggatatgtaatccaaagctggatgcgcagccgcaacacattagagtttctccgccaatgggaaaatgacatgaatgaaggttttgatgatagggcctgtgaggaactgattcatcagggacatacgacatcactgaccattacaccatctctgtggattcgaaagactcacgctgttgggatacaggtaaagcaaggtaaaggtggaggcgtgagtgcttaccctgaaattgctgcaggcttccagctatggatagatccgaaggttcggttggcaatcgttaggaaacatatgtaaaacagaaattgattaaagtgcatgagtggatggagaatggtatgtttcgtatcaaaccagtttactccttccacctgcttatgagtatgggtacgatttgcttcttttccacaatgcacttttcttaagcagtgagtattcgattgcccggtatgcatatccgcaggattactgaggcgtgaaatatgggtaatatctctgaattagaacggcgtatttccattcgcattatactggaagacgctgagataattttcgcgctactatcaagtgaacaagatattagagtatcacataaaaggaacgtctcaaatactaaaagctgatacattacttatttgttaattatggagggagcagctgctccatctaccaatgtgaaagaaatcattacaaaacgattttaaacaactaaatttggaaatctcagtatgtgccagagtttgacagatagtttagtggagtggtgttgaatatgagatttgaagtagttcaacgaggacaaatcgaacgtgtttttacaaaaaatgtgatatacctccacaaagacggttggaatgactggtttaaatatgagacgatgttttatctttcctattctgatgaaaaagggaatacagtggagttggggagcattaagatcggtcagataggaatggagcagaggacccctgatttgccgaaaacttttgaaacgttaaccgattcgttttttacactggggcaaagtgaagattattatgaaaatgtcaaaaaactggaacacggagaactacgagaggatattttaactgcgttaagagatattgcgtataatctgacaatttttgaggcagtgaaacaggaaaatgtcacgcgtgaatctcttatgcgcgatcttggctccagaatcatcagggaacaatttcatcgaatcgctaacgggggcgcgaaattgaccccttttgatatatcctacaagctcccaggtcaggtcggaaccgattaccaactggagtttcatgtagtcccggattccaacccaccgactaacatccatgtattgattgggagaaacggcgtcggaaagacccatatgcttacgtcaatgatacgttgcctttcaacaggcaaccaggatgggcaatatggaaaattcagctttgagcatcgcacaaaattttcaaattttgtatgtgtagcttttagcccgtttgatacctacccaatgccggatgacatagaagaggatgaatatagtggaaaatacacatacattggtttaggcagcgggcaggagatacggatgcagcggctggaggagcagtttattgcggcgctgcggtcatgtaataaatataaagaaaagcgcacattatggattgctactatgacgctactgaactcagaccccatttttgcgaacaatggtgcctccgcgctgctgtctccacaaggaacagaggaaggtgaactggttgtctctgcgcaagagctatttagccgtctaagctctggccataaggtgattttgctgaccttgacctgtctggtagcgattacgatggaacgcactcttgtgctcatggatgagccggaaaatcatctgcacccaccgttgctctctgcatttgttcgggcgttatctgcgttgctgattcaaaaaaacggactggctattatttctacgcactcgcctgttattttgcaggaagtacctaaaaactgcatctggcagctttacagaaacaacacaatactgcgtgcggtacgaccagagcgagaaacattcggtgagaatgttggagtcctcataaacgatgtctttgggcttgaagtgacccattctggctttcatggtatgttacttcagatggttgaagcgggcttaacatacgaggaaatattaaataaattcgattttcgggtcggtatggaagcgagatcgattttgcgcatcctgcttgcaaatagagagtatggaggtaccgaatgagaaaactgaacgctcccggcgattcggttcaagatgtattttcgacgtgtattgaaagctatcgggatgccgcgttaaaaaaccggctcagatcgatagttcctgttctctctgatgaggcatcgcgctttgaagactgtgtattaacatcaaagacccatactattccaacggcggacaatgtaggcggggtggttagcaaggctgagatgttggacatttatgaatccaagtttgtaaaggggactggccggccatattacgataaatatatgtcgctccccacgaatggaaaatgtccattctgtgggattggcactgtgagcacgttggatcactatttgccgaaatccaaatatcctgcactggcaatcacacctaaaaatatgatcccggcctgtcgggactgtaatttgggaaagaaaaggacattttctcctcagaactcagaggaggaaccgttacatccgtattttgacgatgttgaacaggatatctggctgtccgtgagatttgaagttgcgggcaaagagttagttcctacctattttgtgcggaaacctgtagcgtggaacgacttgctgttcaggcgggttgagaatcatatggttttatataatctatacacatcctacgcagtgcatgccgccgaagaaattacaggccgatcgggtatatggcatgtctttctcgatagatgtggtgaagatttccttgcggcatcctttcatgacgaggcggttagcagggaacagttgttcttaaattcatggcagtccgcactttaccgcggattggaggagcatattgattttgtaacccaatggctgcgattatgaacacccccacctaatccgaacagttcccatgaaactgacggattaggtggggcgttttatgactgaaagatttatcatagcaaggttttcggccattttcatatttacgatggaaatgaaatataaaggcacaaaaagtttgaaatcagctttcaaaactgaaattttcggaatccgaacccctatgtagcatgaatacatggctcacctttaatacactttcgccatttgatatggtatccggtttttcaatatgcgatgaggttgccctgtatataggatttgatggaagagtcaatctctcttgaatcctgtttcagaggcatatcccttcgataaagttattccgttttgaacgatgcgaaaaatgatttggcgactgcattgttatgggggttacagagatagaaaatgactgtaccattgcatgctcataaagtaactgccagaaacgatggaaggcatattgtgcccctaaccattgtagaacagaagttcaagttcagaattgagttacatccttgcgcctttgaaagtggaggtgatgaactgtgtactgttcctaatgctttgaataaatttataagatttggtcaataatgaagatatggaattttggggtaaatgctttgcaactgcatcttttttgtccacacaatacaaaactagaaatcgctgcagtttttactgcggcgatttctcattggatcgccccatcagctctgccggtggggcggcccgtaaaaagagctttaatatcaaacatcgagtgaagtgagccgctaacatgaaccttccactaatagaaatctgctattagaacggtgattgcccgtttacgggctgtatggcaagtgatgcaagcggaataaatttccatgtatcttgagacgcttgccggtaataggctcttatagggcctacgcaagcctccggcttaaccggcggttatggcttgaccacagacggattttgctttgattatcggaaggattcctcgtacggggaatcctcttttgtttattgcagcgcagatcatggggccgcactcttcagcatcctgtccagtccccaatggctggaatctgctcacagacatgtgccggggcggcggactgttccagcttgacctggaagggacgtcaagccagagaagaagctttttataattccggcagtgcccagcggcggttggtggaagagtggcctgctgctttgggattcggatcgctgataacgaattttccgctcaccgatgcgcagttttcatgccgcaaagtccggaccctcccgccggaagaacaaccgtctgccttggcggctggctcttataagaaataccatacgcctcttccgccgtgcgtattgagccgtttagggcggcagagcggtttcttcccacgaaaagcggcttttgccttgcgggacatactgcgctgcaaggcggcggaaaggggttccctttgtcgggacgcgagagaacaaaacagcccccccttcggaatgcccgaaggggggctgcggatctatcagagctgcttgaccgtgtaatacaccgccagggcaaagaccactatggccagggcccacatggcgtaataggcgatggtgctgctgaacagagcgatggccagcgccacgacggacaggccgcaggccgcatagatgggcatgggatccgcgccggcagtcaacacctgaagattgcccagcttgccgccattcttgtccgccttgttggtgaggaaagccgctacgatcagtaccacgatatagactaccgcagcgatccggacataggtacccaggaagatgctgtccagcacccgccggcagacccacagggcgatcagggaggcacccaggatggtcagggaccaggagcactcccgatcgtacagattccacagaatgcccagcagcatgaccaccggaaccaccacgcacaggaaggtgagagcggagtcgtagaaggtgcggatcatccaggcggaaccgcccaggaaaacgccggcggcaaacaccgaccagccgatccagcggcgcttggtttgctggcgccagacgatgcccaggaccagaccgatcacagccactgccgcacccgcggccatcagatagggcagtgcggcgtcgcatgcgagaagctcattggcggtgccgttcacatagaagcggcggatgaccaacagatagatctccgccacgcagccggccagaaaaaacttgagcgcgttgtgcatgggctcgttccgctttaccggcttggatttactgacaggatttttggacatataggacaacctccagggtgtttgttccgaaaatagccgcgggaaaacatgcgcttccgctggcatactatgatagtatagcagatatttcgtgcctttgcaaggggaaggagccagacttttcccttttttccaacaggagtcaggattgccggttgagatttgcccgggggcgtggtatactcctctattatgagattttttgcgaaaaatactgatgacaagaggaatttgcttatgaaacgtttgggcgcactgctggcgtcactgctgctggcggggagcctgaccgcctgcggcggcactgcggcgcaggagatgcagagcatacaggtcttcgccatggacacggtgatgggcctgcgggcctgcggcggggagacggaggcggcgcttgcggcggcggaagacgagatctaccgcctggatgaggcgctctcccgcacccgggaggacagcgcagtgtcccggttgaacagcgcggcgggggggacgccggtggatgtgggggaggaactccgcgacctgattgcccgggccctggatttcagcgctgccacagacggggcctttgacatcaccctggcgccggtgtcctctgcctggggctttacggaggacacctaccgggtgccggaggacgctgaactggcgttgctgctgccctgcgtgggggcggagcatgtccacctggaggaggggactgctgtctcgctggaccagggcacccggattgacctgggagccattgccaagggtatgccagcgactggatggctgcgatttaccaggagcacggcatcacccacggcatcgtggacctgggtgggaacacctgggtctgcggcgggaacttggagggggagccctggcagatcggcattcaggacccggcccggtccgcgggggctttggcggggatcctggaggcgtcggacgcctttgccgtcacctccggcggctatcagcggtattttgaggaaaatggacagctctatcaccatatcattgatcctgccaccggccgcccggcggagagcggacttacctccgtcaccgtggtggcggatggggccgcgggcaacggcacgatgtgcgacgccctctccacggccctgttcgtcatgggggaggaccgggcgctggagctctggcgcagcggcgtctatgactttgacctgatcttggtgacagaggacggccggctgctggcgactgcgggcatcgcggaccggttccgtccggacgattcggcggggtatgcgtatgaaatcgtctcctaagctgcggccaaacggctgggatgcgttggcggcggccgctgtgctggcgctggcggtggcctgcgcggctctgttctggactgggggagaggaaataggcccgctgacggcggtagtgtctgcgaacggcgagccggtggatcgggtggtgctggcggacctgtcgggaccggaggagcggacctatacgtccaacggctacaccctccgggtggcctttgggccagagtctgcccaggtgacggtgtccgactgccccacccaggactgcgtccacatgggggagatcacccgcgggggacagagcatcgtgtgcctgcccgcccggatcgtcgtgcagctggagggcggcgcggcggcggatgacggcgtggatctggtgatcggataaggaggcgccatgaaactgacgacgagacagttgacgctgtgcgcggtgctgacggccatggcgctggcgctcagctatctggagaacttcttccccttgtccctggccatccccattccggggatcaagctgggactggccaacatcgtgacgctgttcgccctgtacgccctgggaccggggcaggcgctgctgatcctgctggcccggtgcctgctgggggcggtctttgcaggaaacatgaacgcgctgattttttccctgctggggggcgtgacggccatgggggtgatgatcgccctctcccggctgaagcgcctctccgtctacggagtgtctgtgggcggagcagcggcccacaactgcggccaggtggccgcagctgtgctgacgctgggcaacacggcgccgctgtactacctgccggtgctgctgggggtgtccctctttaccggggcattgacggggctgatcgccgcctgcctgttccgggcgctggcacatacaagactgtggggggtgtgagcggatggacaagcgggatcagagcaaaaaggacgagatcatcctgcggcagctggaggtgatccgctctatgacggagcacaacctcagccgcatgggcgcggacttctggggcactccgacaccggagaagcatgtgcctgtggctccgctgccggagaaagaaaaaaggatcccgccggcagacggcggggagaaaaaggcgccagaggcggcagaacagaaacaggaagacaccgccaaagctccccccaaagagaacatcgaggatctgcagaaggagctggacagctatgtgggcctcagtgcggtgaagcgggaggtgaaagacctcatcaatctggcggcggtggagcgtctgcgccggcagcacggcctgcccacagcggacatgagtctccacatggtgttttccggcaatcccggcacgggaaagaccaccatcgcccggctgatggcacgggtttaccacagcctgggcatcttgtccaaggggcagctggtggaggtagaccgcagcgggctggtggcgggctacgtgggacagacagccatcaagacccggaaggtcatcgactccgctctggggggtgtgctgttcatcgacgaggcatacgccctcaacggcggcggggccaacgacttcggccaggaggccatcgacacgctgctgaaggccatggaggaccaccgggacgacctggtggtgatcgtcgcgggctacgacgggctgatggacgagttcatccactccaatccgggactggagtccaggttcaaccgcttcctccactttgcagattacacggcggaggaactgctggccatcttccggatgcagtgtgaaaaagggtgctacattctggagccggaggcggaggcgccgctgcgctccctgctggaaaggcggatggcggatgcggcctccttcggcaacgcccggggcgtgcgaaacctgtttgagcagatcctggtccggcaggcgggccgtctggcgggacaggcgtccgtcaaccgggaggacctgacgcggatcaccgccgcagatgtggaggcagtgggccgggcaaatgatttggaggcgaaagagcgttgaaggttttgatcttacatcccagcagccgatatgaccggtatctgcccgatattcccgctgcggggcggatggagctggtgttcacggaccgggaggggccggaggagcgctggctggcagccggcggcgatgcggaggctttggtggccgcaccggtgacgccggtgacagaggaactgatcgcccggatgccgcatctcaagctgatccacagcgacggggtgggctacgaccggattgacctggcggcggcccgggaggggggcatctatgtgtgcaactgcgccgggtgcaacgcaggccccgtggcggagctggcggtgacgctgatgagcatgctgctgcaccggacgctgtggggagaccggatggtgcgggccgggcagcagcatgaggcggtgaacgagctggcagcccatgtgccggaagatctgtccacctgccgggtggggctggtgggcttcggcgccatcggccaggctacggcgcagcggctgcgggccaacggcagcgaggtgttttactacgcccggcaccggcaggatccggctgtggaggaggcgtacggcgcccggtatctgcccctgtacgagctggcggagacctgtgacatcatcagcctccatctgcccgccacgccggagagcacccacctgctggaccgggcgttcttcggccggatgcggccggggagctatctggtgaacaccgctcggggcgcggtgatcgacgatgcggccctgtgcgaggctatccgctccggccgtctggcgggggcggcgctggacgcctatgacccggagcctgtgacggcggagcacccgctggtgcggctggcggcggagtgcccggaccggctgatcctctgccccaccagggcgggatcagccatgcggcgttccgggaggccgcgcggatggtgtttgcggatctggaaaagctgatggacggcaagcgtccggaacgggtggtcaacggcctgtaactggcgctgatggagattaagaggccggaagaggagaggcactatgcgcgtaccagagcactgcacagcggatgcggggatgttcttcgacggccatccggcggagctggcgctgtatgaagcgctgttccggcggatggacggggcgtttccggagggaaccgtcaaggtgcagaaaagccagatcagcttttacggccggcatctgttcgctgcggcatctctgccggtgcggcggcggaaggactggccgaagatgtgcctgatggtgaccgttggactgccgtaccggctggactcgccccgggtggtggcggcctcggagccgtatcccggccgctggacccaccatgtcttggtgacagaggcggaccagatcgacgaagagctgatgggctggctgcgggaggcatgggactttgcggagagcaagcgatgagatacacacgggaagagctggcggaggcccggcgatccatcgactccaccctgcgcaagtgtgagaaggcgctggagaagctgcgaccgggcacgtcgccccacacgctgacggtacggcgcatccgggcgttccggatcgccttggcgctgatcgaccgggagatggacgggacggagattcccggtccggaagggaaggaggacctatgagccactatgcctacggatactgcgggatgccctgcgccctctgtacccgctgccggacagagggaagcagccggtgtcccggctgctcctgcgacggatactacaccgtgccctgcaaggtccaccgctgcgtccgggaaaagggactggaccactgcggacagtgcggggacttcccctgcccgaagctggggaagatgggggatttccgggacctggatacgggccgcgtgaaggagcggacctgccgggccgtggcggcggagggcctgcccgcctggctggcggagtatgaggaaaaggcggacctgctgacggtggcgctggagcggtacaacaacggcaggatgaagcggtatctctgcgagctgttcctgcagcaggacctggacaccctgcggcggatcatggcccgggcggaggcattggaaggagcggattccaaggagctgggccgggccttccaggcgctggtgggggagatgctggaatcgtgagcggggcgctgaacagaaaaaaagccaccggagcaaatgctccggtggctttgatgttcgcttattccagctcgaaggcaccagtgtacagctgatagtacagtccgtgctggcggatcagatcgtcgtggtcgccccgctccacgatccggccgtggtccagcaccatgatggcgttggagttgcggacggtggagagccggtgggcgatgacgaacaccgtccggccatacatcagggagtccatgccctgctgaacgatggcctccgtccgggtgtcgatagagctggtggcctcatccaggatcatcaccggcgggtctgccacggctgcccgggcaatggccagcagctgccgctggccttgggacagattggcgccgttgccggtgagcatggtgtcgtacccctggggcaggcggcggatgaagtcgtcggcattggccagggcggcggccgcctccacctcttcatccgtggcatccagattgccgtagcggatgttctcccggacggtgccggtgaagaggttggtgtcctgcagcacgatgcccaggctgcgccgcaggtccggcttgcggatgttgttgatggagatgccgtcgtaacggatcttgccgtcggcaatgtcgtagaaccggttgatcaggttggtgatggtggtcttgccggcgccggtggcacccacgaaggccagcttctggccaggcttggcaaagaggctgatgtcgtggaggatggtcttgccctcctcataggcgaagtccacatggtcgaaccgcacgtcgccggagagcttgatgaggtagtagtcctcgctctcgacattccggaccgggcccaggatggggcggtagaaggccttgccgtgctcctggtatttccaggcccaggcctcgtcttttccagcctcgggggccttcagctccgtgaaggagccgtccgcctcttcccgcacagggaccatcaccatgtcagtgctgtgggggaccctccaggcccagaggttggtgcgcttctcggactcctccagttggtggccctctttgtcataggacacgtttaccagcgtcacagtgccgtggtcctcctccggctcctcgtccatcagggcgaagatccgctccgcgccggccagggccatgatgatggagttgaactgctgggagatctggttgatggggttggaaaagctcttggacagctgcaggaagctggcaataacgcccagggtgatggtggtgtccaccccgctgagggccagagcgccgcccaccatagccacgatcacgtactggacattgccgatgttcaccatgataggcatcaggatgctggcgtaggtgtgggctttgtccgcgctgtggaacatttcgtcgttgacccggtcaaagccgtcctgggcctcctgctcatggcagaagaccttgaccactttctgaccgttgatcatctcctcgatataaccgttgagggcgcccagggtgctctgctggcggaggaaatagcggccgctgcggccggccaggaaccgtgtcaccaccagggcgaagcagacgcacaccaggaccacaaccgtgagcagggcgttggtgaacagcatacccaggaaggtgaccaggatggtcatagaggagttgatgacctgggggatgctctgggcgaacatctgccgcagggtgtccacatcgttggtgtagacgctcatcacgtcgccgtgggcgtgggtgtcaaaatacttgataggcagggtctgcatgtggccgaacaggtcgtcccgaatggttttctgtacgccctgggacaccacgatcatgttccggttataggcgtaagcgcacagggcacccaccaggaacaggcaacccatcatcaccagggcccgcaccaggccggaaaagtctggatccgccgcacccagcaggggggtgatatagtcgtcgatcagactgcccagaaacagagagcccgccacgttggcgatagcactgaccagaatgcacaccagaacaatgatgaagcgggccttgtacccccgtttgatatagcccatcaggcggccgacaatgtgccggcgatggccgggcgccttggcgccgctgcggatctgcttactgctcattgtcactgcctcctttcatttgggattcataggtctcgcggtagatatcacaggttttcagcaattcgtcgtgggtacccatggccacgatctgtccgccgtccatcaccaggatcttgtcggcgtcctcgatggaggagacccgctgggcgatgatgaacttggtggtatccgggatctcctccagaaacgctttgcggatcagggcgtcggtcttggtgtccacggcggaggtggagtcgtccaggatcaggatcttggggtgcttcagcagggcccgggcgatgcaaagccgctgcttctgcccgccggagacgttggagccgccctgctcgatataggtgtcgtacttgtcggggaactcctggataaaggagtccgcctgggccagctggcacatccggaccatctcctcgtcagtggcgtcctttttgccccagcggagattatccttgatggtgccggagaacagcacgttcttctgcagcaccatggccacctggtcccgcagggcgtccatatcgtagtcccggacgtccgcgccgcccaccaggacgcggccctcagtggcgtcgtacagacgggggatcagctggaccagggtggtcttggaggtgccggtgccgcccaggatacctacggtctcaccggacttcaccgtgaggttcacgttcttcaggcactccttgctggggtccttggcgtaggagaagctgacgttctcaaacaccacggagccgtccttgacctcttcgatgggctgggagccgttcttcagatcgctctcctcgttcaggatctctgtgatccgctctgcggaggcccgggccatgatgatcatagtcagtaccatggagagcatcatcaggctcatcagcatcatcatgatgtagctgaacatactggtcagctggccggtggtcatgctgccgcccacgatcaggttggcgccgatccaggacacggagatcatgcaggcatacacacagatctgcatcagaggcatattgaaggccaggatgcgctccgccttggagaagtccatgtagatctcctgggagaccttgccgaacttctctacttcatggtcctcccgaacaaaggacttcaccacccggatacccagcaggttctcctgcaccacgttgttcaggtggtcatagcgcttgaagacccgttcaaaaatggggtgggccctggtcatgatgagcgccaggccgatgcccaggatcgggatgaccaccaggaagatcagtgccagcttggggttgatgcgcagggtgagtacccaggcgcagatcaacatgatgggggaccggaccgcgatacggatgaccatcataaaagccatctggacgttggtcacgtctgtggtcaggcgggtgatgatgccgctggtggagaacttgtcaatgttggcaaaggagaacttctggacattccgatacatctcccgccgcagattccgcgcgaagcccgtagaggccttggcgccgaaacggccggacagtccgccgcagatcagcgccagaacagccattcccaccacggtgaggccgtaggcggcaatatggtgcatgctgccggccttgaccccctcgtccagcagcttgccggtcatcagggggatcaacacgtcaaacgccacttcgccgatgacgaagatgggcgtcaggatggcggctggccagaactcctgaatacagctggccaggctcctttttttcttcatagaatacctccttgtgtctttgctgtgccgggggaagcgattgagccgcttcccggcggggcccggttggtcaaatgagattttgcttcagcttttccgcgatggccaggaactggtcaatctcctcctgagagatgcctctggtcagcgtcgcctctgtggcggcgatccgccgctctgcctcctgattcagcgcctgcgcccggagtgtgggcgtgatccgcttcatccgggcgtccctgactcccatagagcgctggacgaggccctcgtcctccagccgcttcagcagccgggaggcggtggagctgcggatgcagagggcgcgctccagatccttttgatagatttcccggccctggctgtggcagagataaccgatcaaaacgccctcgatctccgtcagcatgctctggggatggtcggcaggcccccaaagccgtctgcgcaggagattggacagtgccttgatctcatacccgacgtaccgctcatgctgcatggaaacacctcctccaactgaacaggattatattttagttagcaaactagcaaatgtcaagaagcaatctgccaaaatttctacgggtcttcctttaaaattcggcaggcaccgaaagagaaggaggcgccccacaccgaagggcggggcgcctctgaaaaaacgggttggaggctgctgttcagcggccgccccgggggcggtccggcaggaaacagaggcaaccggcctgacggctggcgttcaggtcgatgagccgctggttggagctgccccggaaccggagggtcaggtccttcagctcctctacgaagcggccgtccaccagcacatccaacagggagagcatctcgtctgtcacctcgcagcggggatgagtgccgtccgaggtaagctcctcataggtgaagccggagaagccccagatggtcttgtccggatacatctgccggacccgccggagaaagggcaccagggcccgctggttctccggttcaaagggctcgccccccagcagtgtcaggccgttgatgtagacaggggagagcagggagagcaaataatcctccgtctcggtggtaaagggctggccgtagcagaagtcccaggtttggggctgaaagcagttcttgcagtgattggtgcagccggagacgaacagggtaacccgcactccctcgccattggcaatgtcgcagtttttgatctcaccgtagtacatggcggtcctcctgctattcttcaaaatgggcgcccgcaggcgcccatttgagtttgatcgtttttcccggggacatgcgcctcgggaaaaacaccgctcagtttgtaagtgtgcgagcgaagcgagtgcgcgcacaaactgcaatctcttcgttcaaaaggctttgccttttgaacgaaatattttacaggtgcagcacccggtcccggatctcctgagtccggccctggttccagaactgggttccgatgtagccgcaggtccggcgggccacattcatcttgtcctggtctgtgttgccgcactgggggcacttccagatcagcttgccgttctcctccgcgatctggatctcgccgtcccagccgcacacctggcagtagtcggacttggtgttcagttcggcgtagatgatgttttcatagatgaacttcatcacctggagcaccgcctccaggttgttctgcatgtccggcacctccacgtagctgatggcgccgccgggagacagggcctggaactgggcctcaaacttcagcttgtcgaaagcgttgatatcttctgtcacatggacgtggtagctgttggtgatgtagctcttgtcagtgacgccctcgatgatgccgaagcggcgctgcaggctcttggcaaatttataggtggtggactccaaaggcgtaccgtagagggagaaatcgatatcgctctcctccttccacttcctgcaggcgtcgttcatgtactgcatcacctgcagggcgaagggggtggcggaggggtccgtatggctcttgccggtcatgtacttcacgcactcgtagaggccggcgtagcccagggagatggtggagtagccgtggtagagcagcttgtcgatggtctcgcccttcttcagccgggcgcaggcgccgtactgccacagaatcggggccacgtcggagagagtgcccttcagccgattgtgccggcacatcagggcacggtggcacagctccaggcgttcgtcaaagatcttccagaacttgtccaggtcgccgccggaggacagggccacatcgggcagattgatggtcaccacgccctgattgaagcggccgtagtacttgtgcttgccaggctcataattgccggcgtttgcgatgttgccgatgccggcatctgtgaagcggtccggcgtcaggaaggagcggcagcccatgcaggtatacacatcgcccttcagctccagcattttcttggcagagatgtagtcgggcaccatccggcgggcggtgcacttggccgccagcttggtcaggtaataatagggggaatcctcgtggacgttatcctcctccagcacatagatcagcttggggaaggcgggagtgatccacacgcccttttcgttcttcacgccctggtagcgctgctccagggtttcctcaatgatgagggccagatcctttttctcctgctcgttcttggcctcacccaggtacatgaacaccgtcacgaagggggcctggccgttggtggtcagcagggtcagcacttggtactggatggtctggacgccgcggcggacctcatcccgcagacgggtctccaccagctcctcgatcttctcccgggtgggccggatgcccagggcctccatctcctgctccaccagccggcggatcttcttccggctcacatccacgaagggggccaggtgggccagggagatagactgcccgccgtactggttggaagccacctgagcgatgatctgagtggcaatgttgcaggcggtggagaagctgtggggccgctcgatcagggtgtccgtgatgacggtgccgttctgaagcatatcctccagattcaccaggtcacagttgtgcatgtgctgggcgtagtagtccgagtcatggaagtggatgatgccctcccgatgggcctccacgatgtcggcgggcagcagcagccgctcgctcaggtcccgggagacctcgccggccatgtagtcccgctgggtggagttcaccaccgggttcttgttggagttctcctgcttggcctcctcgttgcagcactcgatgaggctgaggatcttctcgtcggtggtattgctcttgcggaccagagagcggacatagcggtaggtgatgtagttcttggccacctcataggccccgtgagccatgatctgggactccaccaggtcctgaatctcctccacagagggggagcggttcatcttctgacagctgagttccacggactccgcgatccgctggatctggaccggggtcatccgggcgtcctcctcgatagtgttgttggccttggtgatggcggcgatgatcttcgtgatgtcgaagatgacctccgtgccgttccgcttcatgactttcatgggactctccgcctctcttgtagaatcaatctcaattgtaatatatctagtaagcattgttatcataccacactagatatgggatgaaaagttgcatttaccatagtgtcttccaaaattcggcgaggaaatttgtgcgttccggagaaaagctgtcgatgcggaaaaaccgccccgtgcggcagggcgcggagcggtcgggatccggagaacagtcaggtcagctctgtgtatttggcggcgctgccccgggccttttccaccgggtacttggcggcgttctgatccaccttggcgttcaggatctcatccagatccaggccgcacacatcggccatcaggacgcagtagctcagcacatccgccagctcctcccggatgcggcccagcttgtcccggcattccaggtccgcgccgctccactggaatatctccagcagctccgccgcctccagggacagggagatggccaggtccttgggggtgtggaactgccgccactcccggtcgtcccggaactggatcacccgacggatcgtctcatcccgcagcatggatgtcaactccttttccataaaatcaggattcactccgcccggacagcccagcgcagcttggtggagtgggcccgggggttccggcggcactcctgaggggagggacgggtgacctcctgggcgatgtcgctgtaaagcccctcccggtactgctggcggaaggcctgcttcaccagccggtcctccccggagtgaaaggtgaggatggccgcccgcccgccgggcttcagcacatgggggagcttttccagaaaggcgtacagcacctcgaactcactgttcacgtcgatccgcagcgcctggaaggtccgctgacaggacttcttcaccgcctccttccgctccccggcggggaggaaagacagcgccccctcaatgagggcgtacagctggcgggtggtatccacagtgccgccccggcggaacacctgaatgacggcctttgcgatgcggtccgcgtagggctcgtcggaattttccgccagcaggttctccagctcctcctggtccagctgccgcagccgctccgccgcggtgacgccggaggaggggtccagccgcaggtccaggggaccgtcctgcttgaaggtaaagccccgggccgggtcgtcgatctgcatggaggagacgcctaaatccgccagcacgaagtcgaagagcacgccgggggccacctggtccacgtcggcgaaattccgatgctggatggtgaggagctccggcccgaagcccgcagatgccagccgggcgcgggtcttttccatctcgatggggtccacgtccgtggcatataggtgtccttgcccctggagctgtgccagcatccggcgggtgtggccgccgtagcccagcgtggcgtcgtagccggtctggcccggctggatctgaaggacctccaggatctcgtctaccagaatggggatgtgcatccctgccggggtcttgccgctctcgatgatcttttctacatcagagcggtagttctccgggtcatgctctttgtacttctcctgaaaggtgcgggggtgggtgcccttgtaccgggggcggcgcttgtgctcctgctccatgggatcaactccttctctgaaccgctatcatatcacagccgcagccaaaagaaaagtcccgccgcattgacagagcggcggggaccggatacaatagacattcagcaaggaggcagatttttatggtaactttggcacagcgcattgaggagctgcggaccgccaggggcctgagccgtccggctcttgccgccgccctgggcttcccccgcacggcgattgaaaagtttgagacgggccgccagacccccacccaggaccagcagaacaagctggcgtcctacttcggcgtgtccctcttctatctccggggagagaccaacgacaccacccagatgtccgactggatggacggggcgtttctggacgagcccgccccggttccggcccccaggcgggcggcagtgaagccggcggtggcggcgtcctccggcggggagggcggcaccatgttcgacgcgttcctcaccagcaagaaattccaggaggcactgcgcaccgcggtgctggatactctccgcacgccggagggccaggagctcctgaccaaggccatccggaaagagctggcgaatcggcagaagtgatgtgcggcggcgaaaggggcgggggatcgtgatctcccatcctgtgtgtgctccgggtgtatgggggaggcgaaatgcggccggagggaaaatccgcggaacgtttgccaacatccgctgcgcataataccatacagaaatcaggagggaactgacggatacagactggggggcaggctcagatgaagaatgttctgtatataatcaaagtggtggcactggcctgtgcggccggagtgattatgacgatcctgggggcttttccgcctctgtcgttcctgtataactggcttgtgggccacggcctgcaaaatgtatgggttggactgatggccggtgtcatcgccatctgcgtgtccctgtacaatatgcaccacgcgaaaaagaaacggaagtgagcgatttgcgctcagtccggctgagaggcttggatgctctgaccaatcaaaagagccgcgggagtttgatcccgcggctcttcttgcgcgtttacaggctcttgatgaacttctcgatccggtccaatccctctttcaggtccgcgtcggagtagcagtagctcaggcgcatgaacccctcggtgccgaagtggatgccggggatgacgcccaccaggccctccttcagcatccgggtgcagaaggtgttggagtccatgccgaacttccggatgtccacaaacatgtagaaggcgccctccggcttctccgcgtccaggcccatgtccaccaggcgctggtagacgtagtcccggcgcctgcggaagatctccaccacatcgctggtgtccgtctccagggccgtgacgcaggcccgctggacaaaggagggcacggaggtgacacagtactggtggaacacctggatccggtccatcagcttggcgtccgccatgcagtagcccaggcgccagccggtcatggcataaggcttggagaagctctggaccacaatgatccggtcccgcatgtcctggtactcagcaaagctgtggtagtcctcacagtaggtcagagtgcggtacacatcgtcgcacaggacaaagatgggcttgtcccggaggatggcgtggacggcgtccagggtctccttggtgtagacgcagccggtgggattgttgggggaggtcaggatgatggccttggtcctgtcggtgatggcggccttcagctcctccggcacgatctggaagtggttgtgctctgtgggcagggagacgggcacaccgccctgcagctggaccagcgcctcatacaggccgaaggcaggggtggggatgatgacctcgtcccctgggttcaggatggtggagaaggaggcgaacagcgcctccgtggcgcccaccgtcaggatgatctcactgggggcgtagtggaggccatgggcctcggcctcgaatttggagatggcctccagcgcgtagggatagccgttgccgggggatagtgggtatcgttggcgtccagagcggccttggcggcctccttgatgacgtcgggggtgttcagatccggctcgccgatggtcagggcgcaggcgccgggggtatcccgcaccagataggtgaactgccggatgccggacagctccacgcccataacggcattgttcagagtcaggtccatggattttcacgctcctttttgttcatgaaattcagtatatccggataaaaaagggatgtcaacggcagtttccacaaaaagggaggcaccgaaaagaaagcggccccgccgcaatctgcggcggggcctgctgggagactgcattttcaggtgggctgattggaagaggcagcatcttctgccggctggcccgtttcggcgggggcatcagctggcgcctcctccggggtgaaggtcacgggggtctctccggcccgggcgacggaggtgccggagagaatgccgccgccctcccctgcggtgtaggcgatagtcacctgatccccggcattcaggatcaccgccagggggttctccgcggcgttgacggcgtagaaggtgtcctgtccctccagccgcaggaagtagtaggaattgccgtccagcacagcggtgcggatctcagcgatggcgccgctgatctcctcctggtcagagggaacagcctccgcatccccgtcggagatgaggccgctgtcggccagtgcccggcggtaattggcctcgcactccgctacggtgctgccggtctctacaatgttgtactgctggacgttcaccatggcgtacatcttcaccagaccgtcttcacccttgagggacatgaagtaggtgggctggtcggcgatgttcagcagcaacgggaaggtggccacgtaacgcatctgctggacctgactcatggcgctggcctgcgcggacgcctctgtggcgccggcgacagaatagaagtgcgtctccttggtccgctggttggagaggatgaatccgatgttggactggtcggatgtcacagaggtgacaccggtatacatatacacgtcatccccgatggcaatataattgtagccttctgtggtgtgcgtcacatcccgctggccgaaaatggagttgataaagccgttgtggtacattccgtaataatcgtactgctccataatcagattcgcgtcatagacgtggtccacccagttggggacctcctcataatactggctctccccggtaacggcgttcaccagaacggccccctggatgtccgtgccgccgaagaggccgatggtcttcaccatgcgggggcagacccagtagggctcgccctcttcattgatctcaaacaccggatcggcaaacatatatgtgggatagtggaaccgcaggtggcggggcagataccgcccgaaatgctcggcggtggtatatttcatcccctcgtccaggcggaccacttccgcctcctgggtcaccatgtcgataatcagataagcgggcaggcccgcggagcggttggtgaaccacttgaccagatctccataggccagggaagtcacgcgcaccgggcgaccctggtagttgatctgggtgtaggagggcaggatctcaaactgggagaccatatccgccagttcgcccagtttgcggctgcccaggcgcgcggcggagtcttcgtccagcatggggatctgattgtaggagatctcctccacctcggaagcaaaatcaccatctttgatggaaagcagcttgctgtagcttccggcccggattaccacccaagaggtaaggccgccgatgatgatggcggcgatcagagccaccaggaccaggaaggggatggtgcactgctttttcacaaagccgaagtaccccttcacgccctccccctgaaagccggaggtgagcacggcgcacacgcagtacaccgcgcacagcaggaacacgaagacatagaactcctccgcgtggaagttcagggcgggcagctcgaagtaaaagtaccccaggccgaacagcagcgtcacgcccagattgatgagcgtccgcgtgaaggcgttgccaatggccttgcggggcttccgctcccgcttgggacgctggggctgggaggcgtccccgccgctgaaaccgccgaaagcactggggtcaaagcctccgaagtcaaatgaaaatggcataaaaacccaattcctcctttttcagatgggccgaattgaaacccatgatacaggaaaagtgtgaacaaatcaaggtttcccgtcagaacaccattccgattccgaaaagattatggtaaaatcaaaacaacatgtaagctctgtgcggaaactgcgtgtagagaagtggagaggagggacggcattggaggatgcccggatcgtggagctgtactgggagcgggacgaggcggccattgcggagagcagcgccaagtacggcggctactgctaccagatcgccttccgcatcctggccctgcgggaggacgcggaggagtgcgtgggagacacctggctgcgggcctgggaggccatgccgcccagccgccccggcaggctggatacgttcctggggaagatcacccggaacctgtccctggaccgctggcgggccctgcgggcccagaagcggtggcagggacaggcggaactggcgctgacggagctgggggactgcctgcccgcctccggcggcgtggaacaggaggtggaggccgccgccctggcggagagcctgaaccgctttttggaatccctgccccaggagaaacgggtgctgtttgtccgtcggtactggtatctctgctccgtggaggagctggccgcctggagcggcaggcggcgggggacggtctccgcggcgctgttccgcctgcggcaggacctgcaggaacacttggagagggagggattcaccctatgacaagggaacagctgctggatgctgtgggagatatccgggatgcgttcatccgggaggccgcgccgccgcccgcctcgtaccgcaagcagcgggaattcccctggaccggcgcggtggcggcctgcctggcgctgatgatcgtgggctccacattcttcctgtcacagatgaacatgggggacggagccactggaagcggcggcgcctctgccgtcacggaggacacggcggaggtcggtgagtccggcggaacggtgaacggtgcagcagacggcacagacgattctgagccggagacagcggcgatcactgtcacggtggatggcacggtgtatgtgcaggcaggcggcgtgggccgccatccagaggcgtgcccggagggattctcctacgctggagaggcggagctgccggacaccggggagctttgtccctactatgccgacccggagcggccggggcagatctatgtctatcagagctgctgggatgaggggaccggaaccacctatatggcctatgtccgctacgaggcggagacaacaaactgaccgcgggcggaaagagaaagcagggccgccggaggggatcccctccggcggccttttgcgtatgagcctgtcctcacggcagcatcagcagctttttcaaaaattccacgcccctgggcagaacggcctcgtcatcaaaggtgaagtccggggcgtgaagctggggggtatccccggtgcccaggaagaagaacagccccggcacatactgctggtagaaggagaagtcctccgccgccagcaccggcttttccatgagggtcggcgcgttatcgcccagctgggcggcgatcttctgatagagctcttcgtggttccacacggcggggtaaccctcgctgaggtggacgtccaggctgcagccggtctccgctgccacggaccggccgatgtccttcagctgctgacggcagaaacggaaggtgtcctcccggtaggtgcgcaggctcccctccagcacggtgcggccgctgatggcgttccggactgtgccggagaccatcttgccgaaccgcagcacccggggctggtccgggggcagctgttccatcatgtcataggcccgctggaggtaggagatgcccgccgtcagggcgtccagccctcgtccgcccgggacatgtggacgctgcggccttctacggtgacggtgacctcgttggaccgtgccatcagcgggccggggcgggaggcgatggtcccggcctccaggccgggccacaggtgcaggccgaagatccggcggacccggtagcgctccagcacgccgctctcacacagctttccggcgccgccggtggtctcctccgacggctggaagaggaagagcacgttccggggcagctcggccagatgctccgccgcatactccgccagggtcaggaccatggcggtgtgggcatcgtggccgcaggcatgcatccgcccgggatggacagaggcgtagggcaggtccgtggcctccgtcaccggaagcgcgtccagctccgcccgaaatgccacggcatcgctcttccctgcgtcgaaccaggcgcagacgctgccggtgatgggagagaacacccggcagggcagcggggccaaaatgcgctggaccagctgaaccgtctccggcagctggttatccagctccgggatgcggtgcagggcacggcggtaatcgacggcggacatggacaggacctccccttctgagatgacattaataatcatatcataccacagacacggtcgggtgaccagaggaaccgggatttttcgtcccttttgacaaggaaacgggactgccagacgcgcttttttccgttttttcccttgccaaaagggagaatgtaatggtatgataccagaaaatgagatagaggcgcggatgcgacgagaccatgggagccgacgggcgaggatcgtgggggaggcaagtccgccgaactccctggtcaggtatgggcagggggtgggtccgtggggaatacccacgggactgtccgcggaattttccgcgggggcgctatccgcttacagggaactccgctttttgcatgggtgcagaggtgtgaaagagctgtcggtaggggcgtgtctctaccgacttttttgttgcttcaaccaacggacaaaaagaaagacggaggacactcacatgaaatttgaacatctgcaaggttccattgtcgccatggtcaccccgttccgccaggacggcagcgtcaacttcgatatgctgacagagctgctggagcggcagatcgccgccggtaccgacggcatcctgaccctgggcaccaccggcgaatactccacgatgagccatgaggaggatgccgctgtggtggagcacaccatccgggtggtggacggccgggtgccggtgatggtgggcagcggctccaactgcactgtcacccagatcgagaagagccggctgtaccagtccatgggggcggatgccctgctgctgatctccccctactacaacaaggctaacgcggaggggatgtaccgccacttcgccgagacggcggacgcggtggacattccctgcatcctctataatgtgccgggccgtacaggctgctccatcccggtttccgtggtggaacggctggcccggcaccccaacatcgccggcatcaaagaagccagcggcgatatgtcctacgccatgaagatcgctcgctgcgtgggaccggatttcgccctgtactccggcaacgacgacatcactgtgcccatcctcagcatcggcggcagcggcgtcatctccgtctacgccaacgtgatgcccgccatgtgccgccagatcgtggcggactggctggacgggaaccatgcccgggccctggagaaccacctgcggtacctgcagttgatgaacgacctgttcctggaggtgaaccccatcccggtgaaggccgccatgaatatgatggggctggacgtgggtcccatgcggctgcccctgtgcgagatgggggaggccaacgccgccacactccgccggacgctggaggaggcgggactgctgtgaggatcattttgatcggccggggcaaaatggggacgctgatccgggagaccgctgcggccgccggggatgagattgaggccgtcttcggccgggacgatctgggccagctgggcagactggggcgtgtagcggacgtggtgatggatttttcccgcccggaggctctgccggaggtcgcctcctatgtccgccggacggggacgccactcctctctggaaccaccgggtatacggaggcggagaaggggagtctctttgccctgggctctgcggccccggtgctgtggagcgccaactactccctgggggtggcggtgctggcccgggccctgcaggtcatcgccccggtgctggggccggattttgacatcgagatcaccgagacccaccacagccagaaggcggacgcccccagcggcaccgcaaagctgctgctggaagctgtcgatccccagcaccgcctgcggccggtgtatggccgggaggggaactgcggccgccgggagaaggatgaggtaggcatccacgcactccggggcggcaccgtggccgggacccacacggtccatttctttgggccggatgaggaactggagctgacccaccgggctgccagccgccagatctttgtgaacggggccctgcacatcgcccggctgctgcctgggcggcccaaaggggtctatgacctgcaaaaaatcttgtttggagcgtgatggctttgaatgcacaggaaatcatcaactatatcgcagattcccccaagaagaccccagtaaagatttacgtcaacctgtcggctccggtggacttcggatccgctgaagtgttcggtgagggaaagagccgcatcgtctttggggactgggccgagctggcgcccatcctggaggacaaccgggagaagatcaccgactgcgtggtggagaacgaccgccggaactccggcgtgcccctgctggacctgaaagatctcaaggcccggatcgaacccggggccatcattcgggagaaggtggagatcggcgagggtgccgtcatcatgatgggggccatcctcaatatcggtgctgtggtgggcaaacgcaccatgatcgacatgggggctgtcctgggcggacgggccacggtgggagacgactgccacatcggcgccggagccgtgctggccggggtggtggagcccgcctccgccaccccggtagtggtggaggacggcgtcctggtgggcgccaacgccgtggtgatcgagggggtgcggatcggcgccggggctgtggtggccgcgggcgctgttgtgacggagaacgtccctcccaacgcggtggtggccggaacccccgccaggatcatcaagatgaaggacgcccggacggagggaaagaccgccctggtggacgccttgcggagcctgtgaactggagaagaagcggccctgcggcgttgtgccgcagggtcccttttatcagaacgtcaaaatttaagacaaaaatttggcggcaatcgtttgcggtttcgattgcctggggcggcgccttgtgatattgtaatagcaacaatcgaacaggggggctggacatgctggtattggacttcatcaacgtgggcaacggcgactccatcctggtccgggagatggagggggaacggctgcgtttttccatgctggtggactgcggccacgacagcctggagcgggacgaccacccgccggtggaggacccccgctcctgccggatctttgccggggatttcctgcgaagtcaaggtgtggcgcatctggatatcctgctggtcacccacttccaccgggaccacatcggtggtctgggccgggtgctggagaccgtcactgtgggcgagctgctgaccccctatgcgccccccgccgattccggccctctggacccggacggagacaacggcctgcccaaggcagcgcggaacgtgctgcggtgtatggacctgtacgccggccccctgcggcggtacggagaccggatcggccggatcaaggagctgccgggggaccgggtggagtgtctccggctgacggacgacctcaccatggacatcctgttcggcgagcccgccctgtacccccggcagagagcggtgtacgacgccgccttccggggggagcggaacggctatgacctgattcactggggaaagtccatgaacgtctccagcctgcgccagcggctgtactaccatgggaaggagatcgttctggggggcgacgcctacgcccacatgtgggagacgcagaccgccaccccctgcgacatcctgaaggtgccccaccatgcctccctgtcctccaccacccggaagctgctgcggctgctccagccgaaagccgccgtggtctgcgtggccgccggacgtccggacgagcggccccatccttatatcgtctccctgctgaaggaatttacggaagatgtccatttcaccgatgcggtggagatccccggcctggtggagccggtgttccacacgtccgtccatatagagctgccatgaggagttctctgataaaaaagagaccgccccagccgccgttttcaaaacggcggctggggcggtgcggcttcagggggaagcagattactgcacgccctcccggttcagcagctccaggattctggcgtcatcttccaccgtggcgctgggcatggggaaggtgcccgcactggtggcggcgatgccccgcaggcggcaggcctccttgatgacgggcaggaaggggctgcggatggcatacaggtccatcagatggtcgatggtctgctggcctctggcgatgccggccaggtcgttctcccggaaggcgcggacccaggcggcgcagatctccggcaccacgttgctgagggcgccgatgcagccgttgccgccggagagtacattgtgggcgaagttgtcgtcaaagccggagtagatctcgaactgggggatctgggacttgacgaccttgatgagctcccgggtgtggtccatgccgggaacggtgtctttcatgcccacgatgttggggtgcatcttggccaaagccagcaccgtctcaggcgggatcgtgtagccggtgttgtcagggaagttgtagatgtagatatcgccgtgaatttgctcggccaggcggtcatagtattgcagcagagcggaggggccgaagtggaagtagtagggcggcaggatcataacggcgtcggctcctgcgtccaggcagaagttggaaaagctgatgatctcgtccgctaccatgtggctggtgccgatgatcagcttcacccggtggtcgatcttctcgatggcgaatttggccatctcccggcgctggttcatgggcatggcgaaaaactcgctgctgctgccctccaccaggatgccgtctacgccctggtcgatgagattgttgaacagacgctcctggctggccaggtccagcgtgccatcctcgttgaagagtgtgatggccggcgtcagatatgctgcgttcatagaaaagtcctccttcatacggccccgggaccgctggctccaaacccgcggggtgagattttgaaaacgcacgggcggggcgcgaaaaacaggctttagtataacaaaacggcgctgaatgtcaagagaagatctggtaaaatcccgccggttggaaaacagggcggcggcgcatgcccgcttgtcaaacgaagcggcatctgatatgatcggcctggagaaatcaatcggcggcggagagcgccggcgtggaaggagcacgatatgacacagggacagcatcgggccacagcccgggttttggatattctggagagcctgtccggctcagaggagggcttgacgctgacagaattgtcacaggccctggatgccccgaagagcagcctgtttcccatcgtacatacgctggaggagcggcgatacctccggcaggacgatgggacgggccggtatactatgggtccccgggcgctggtgctgggagcggccttctcggcggaccgggggctggcacccattacccaggtgatgaaggaggtggcttccaaatgccaggagacatgccagatgggcattctggaccaagacagggtgctgtatgtggcgcgggaggattctccccagcccatccggctgatttcctgggtggggacccgcctgccggccaacgccactgccgtcggtaaggctctgctcagcggcctgacgaacgaggaggtgcgggcgctgtatgccgggggcctgccccggctgacagagcagaccatcacggatgtggagaccctgctggcccagttggaggcggtccggcgcggggaactggctatggagcgggaggaatccacggaccagctggcctgctgggccgcgccgctgcggcggaagggaacggtgttcgcggctctcagcatctccgtaccgctgttccgctgccgggaagagaagatcgagctggtccgccgcagtctcctgactgcccaggcggagatcgaaaagctggccgaaacgcgaaactttggcttgtctgagaattgacaaactgggaacggcatgatataatgcgaccgaaaattccaaaataagaactgagttcgacataaggaacagaaaagggcgccgcgctgacaagagtctgtcttggtgtcccccttgcacggagatctgtgtgcggtcccagagccgtccggcggctgggacaggatccgtggccagagtccctgacaacggggcttttttaagataaatccctttggtgtgacggcccgcatgatcggccgctcatgcggggaatgctcgcaaatggccaggggagaggccctctgcccccccagcaaacaaattgaggaggaagaaagaccatgatcatgcgattcctgaaaaagatccccgcaggtatgatggtcgtcccgatgctgctcggcgcgattatcaataccttccttccggaggtcaccaacatcggctccttcaccaccgccgtcttcaccagtgccggcgccaacaccgccatcggtatccagctgttctgcctgggcaccacgctgcgggtccgggacatgggcggcgttgtcaagcggggcggtgtgctgctgatctccaagttcgtcatcggcgccgccatcggcattgtggtgggcaaggtgttcggccccactggtgtgctgggcctgagctctctggccatcatctccgccgtcacgaactccaacggctccatctatctggccctgatgaactcctacggtgacaccgtggaccaggcggccatgcctctgctggccatcaacgacggccccatgctgaccatgatcgctatgggcatcggcggcctggccgatatccccttcatggcccttgtggctgctatcggccccatcctggtgggtatgatcctgggcaacatcgacaaggacctgtctgacttcctggcccccgccggcaccatcctgctgccctttgtgggcttctgcctgggcgctggcatgaacctgaccaacatcgccaagggcggcgcgcagggcattctgctgggccttgtcacctgcctcatcggcggcgccttcattgtgctgtgcgaccgcttcatcagccgccgtcccggctatgccggctgggctgtggcaaccaccgcaggcaacgccgtggcagtgcccgccgttatcgccgaggcggatccctcttgggcgcagtgggcggatgtggccacctctcaggtggcggcgtctgccatcctgaccgccattctggtccccatcattacctcttggtgggccaagaagttcggctgccccaagttcccgaaagacgaggcacagaaagccctgtttgagaagcactgattcccattacacatattcgttgaggaacgaaaggagtattacattatgttgaacggcatgatcgttgagcccgtggacaacgtggtggtcgccatcgagcccgtgaagaagggcgagaccgtcacctacatgtgcgcgggcgaggagaagcgcctgactgcggcggaggacatcaccatctatcacaagctggctgcctgcgacatcgccaaaggccagcccatcgtcaagtacggcgagcacatcggcctggcggcccgggacatcaaggccggcgagcacgtgcactgccacaacctggaagagcaccgggaaaacctggacagcaagggctgagaaggaggatacgagtatgaatttctacggttacaagcgtccggacggccgcgtgggcgtccgcaacaaggtcctgatcctgcctgccagtgtctgcgcctctgataccacccgtatcatctcccagcaggtggtgggctccgtcaccttcaacaaccagttgggctgctcccaggtggctcccgaccagcagttcaccatggacgttatggccggctatgccgccaaccccaatgtctacggcaccgtggtggtgtccctgggctgcgagaactgccagatggacctggtggtgaaggccatccaggagcgcaccaacaagcccctgaagcaggtcatcatccaggaggccggcggcaccctgaaggccatcgacatggccgtccgctacgccaaggagatggtggaggaggcctccctgctgcagaaggaggagttccccatgtccgagctgattatcggcacggagtgcggcggctctgaccccaccagcggcctggcggccaaccccctgatcggccagctcagcgacctgattgtcaaggagggcggcacctccatcctgtctgagaccactgagttcatcggcgccgagcacctgctggcccgccgcgccatcaacaaggaggttcacgaccgcatctttgagatcgtccaccgctatgaggactccctgcgcctggtgggcgaggaagtccgtgagggcaacccctctcccggcaacaaggccggcggcctgacctgcctggaggagaagtccctgggctgcatccacaagggcggccatagccctgtcatggcggtctatgactacgccaagcaggtggaggccaagcagggcctggtcatcatggataccccgggcaacgacccctcctctgtggcggccatggtggccggcggcgcccagattgtggtgttctccaccggccgcggcacccccaccggcaatcccctggcccccgtcatcaagatcaccggcaacaagctgacctacgccaatatgattgacaacatcgatgtggatgcctctcccctgatctacggtaccaagaccatcgaggagctggggcaggagctgttgaagctcacgcaggaagtggcctgcggcaagcagaccaaggccgagtctctgggttataccgagatggccatcgctcgcgtgtgcaacttcgtgtaagctctgctggacgtcgcgcatagaagtaaagagaatccatcatgcagccgcggcggtacgatatgcaaatccccccttatcgtgccgccgcggcttttcacaagcacccacccatctgccgggcgggatcgccgcagggaaatgcggcgcattttataacaggagatgagtataccgatgaaaaagaaatttgccgtcatggacggcaatacggccgcggcccatgtggcatacgcgttcacagaggtcgcggcgatctatcccatcaccccgtcctctcccatggcggagaaggtggacgagtggtccgccaaggggcggaagaacctgttcggctccacggtggacgtcatccagatgcagtctgaagccggcgccgcgggcacctgccacggctccctgcaggccggcgctctgaccaccacctttacatcctcccagggtttgatgctgatgatcccagccatgtacgccatgggcggccaattcctgcccagcgtcatgcacatcgcctcccgcgtggtgaccagcaaccaccactctatcttcggcgatcacaccgacttcatgacctgccgcaccaccggctacgccatgctgatgtcctcctgcccccaggaggccatggacctgggcgcggtggcccacctgtccgccatcagcggcaagtacgccttcatgcactgcttcgacggcttccgcacctctcatgagatgcagcggatcgaggcgttggactatgaggacctgcgtcctctggtagaccaggaggccctgcaggagttccgccgccacgccctgaacccggagcaccccaccaaccggggcaacaacgtgaaccccgacgtgtacttccagtgcaaggagggcgccaacgtcaaggccgcctccatccctgacacggtccagcattacatggacgagattaacaagctcaccggtcgggactacaagctgttcaactactacggcgcgcctgacgcggaggaggtcatcgtggtgatgtgctccgccagcgaggccgtgaaggaaaccgtggactacctgaacgccaagggccgcaaggtgggcatggtgcagatccacctgtaccggcccttctccgtgaagcacttcgcagcggccatccccgccacggtgaagaagatcgccgtgttggaccggtccaaggagaccggctccgtgggcgagcccgtgtatctggacgtggtcaccgccctgaatcaggcgggccgcggcgacatccgtgtggtgggcggccggtacggtctcagctccaaggacaccaccccgggccagttcatcgccgtgtatgacaatctgaagctggagaatcccaagaacagcttcaccatcggcatcaacgacgacgtgactcacacctctctggactacaaggaggtggagctgcctcatcccggcgaggtttcctgcaagatctggggcctgggcggcgacggcacggtgggcgccaacaagaacgccatctccaccatcggcctggtggccaacaagtacgcacaggcgtatttctcctatgactccatgaagtccggcggcctgacccagagccatctgcgcttcggtgacgagcctatccgctccacctatctggtgtcctccgcggactttgtggcggtccatgcccccacctatgtcaacaagtacgacaccaccgaggatctgaaggacggcggcatcttcctgctgaactgcccctggagcgcggaggagctggagacccgcctgcccggcaagatgaagcgggacctggcccggaagcacgccaacttctacatcatcgacgccgccaagctggcggtgcaggtgggccttggcgagaagcggaccaacaacatccttcaggctgccttctttgccctgaccaaggtcatccccctggatatggccgtggaggacatgaagaagaacaactacaactcctatttcaagaaggccggccagaagatcgtggatctgaacgacaaggccgtggatctgggcatcagcgccgctgtgaaggtggagatccccgcctcctgggcggacgcgcctgacactcccatggccgagcccaagaacgcctctgcctttgtccgtgacatcgtgctgcccatggaccggcagcagggcgacaagctgcctgtgtctgtgttccagaagcacggcgtgctggacggcacctgggaaaacgggacctccgctttctccaagcggggcgtggcaaccaaggtgcccaagtggaacgcggagagctgcatccagtgcaaccgctgcgccatgtgctgcccccacgccgccatccggcccgtgctgctggccgaggaggagaaggcccaggtgcccgcgtcctttgagaccgtgcccgccaagggcctgggcaaggacgcccccagctacttcttccggatgcaggtctctccctatgactgcctgggctgcggcgtgtgcctgaccgcctgcccggccaatcagagcgacaagacggcggacgccctggtgatgacccccttcgaggagatgaagtccgaacaggcgaacttcgacgaggtcgccatgaacgacaagtacctgaagaaggatgtgatcaacagcaagaccgtcaagaacatgcagttcgccaagccgtacttccagttctccgccgcctgcgccggctgcgccgagaccacctacatcaagctgctgagccagatggtgggcgaccggatgtacgcgggcaacgccgcaggttgctcctccgccatctccggcggcgcgcccatcctgccctactgcaaggacagccagggccgcggccccgcctgggagcactccctgtttgaggacaacgccgagttcgcctacggcttcttccacgctcaggatgccatccgcaaggagctgctgatccggctggagagcatgaaggacgccgacatcgcccctgcggagatcgaggactacatcaacaactggaacgacggagagaagtcccgcgccgtgtccgacgccctgatcgccgccctggagaagtgcgagcagaccgaagatgtgtcctatatcctggagaaccgtgagtatctctccaagaagtccatctgggccatcggcggcgacggctgggcctacgacatcggcttcggcggcatcgatcacgtcatggcccagaaccgggatgtgaacctgctggtgctggacaccgaggtgtactccaacaccggcggccagtcctccaagtccacccccacctccgccgtggccaagttcgccgccggcggcaagcaggtggccaagaaggacctgggcgccatcctgatgacctacggctatgtgtatgtggcccaggtggccatgggttatgaccaggcccagaccctgaaggccctgcgggaggcggagtcctatcccggccccgccatcgtcatctgctactgcccctgcctggagcagcatatcaaagccggcatgagctgtacccaggacgagatgaagaaggcggtggagtgcggctactggcacctgtaccggtatgatccccggcgcatcgccgagggcaagaaccccttccagctggactctcccgcgcccgatactgacaagctcatggacttcctcatgggcgagaaccgcttcgcctctctgaagaacaacttccccgagcgggcggacgccctgtaccagaaggagatcgccgacgtcaaggcccggtaccagaagtaccgcaagatggcggaggactgatttccgaaggaacagatcaaatacagatgccccggcgccggttacggcgccggggcgttttctctgcgctgcgggcattcctgcccgcggcgctttttgtggtgagcggagggagagatgcatataacctggaagagaggaaggcgggaaaagaaatttccgccgcgttgcacgccgccgtgcgcgccggccgggaaataaaggatatggttgacggctccggctatgcatagcggagccgccggaaaggcacgatagcggttgaagccaagcgaatttcagagcagggaggacacgaacgtgaagagatggcacaaggccttgatcctatcgctgatgggcggggatctctactgcatggtggagctgatctggcgggggcacacccactggagcatgtttctgctggcggcgatgctgagtctgccgctagatttggccaacgagcacatggcctgggagcggcccctgtggctccaggcgctgatcgggggcagcgtcattaccttggcggagctgggagccgggctgatcctgaacgtctggctgaagctggacatctgggactactcccgcctgccggggaacctgtggggacaggtgtgcctgaagtacgccctgctgtgggtggtgctggcggggaccgccatcgtgctgttcgactggatgcggcactggctgtttcaagaggagcggccccactaccgctggatctgagaggagggatgcaggatcggaacggaggtgctctgcgcgctgatcgccggagcggctaccgtactggcggctggggcggaataccgctcccggaagagtgccaggcgagcagaggcccgggcagcgcgccgggctacggagagcaggctggctatggatctgatgtacgccacctgttcgttgtccctgaccacggccaaaaagttggcgggtcaacataccaacggcgacgtggaggaggccatgcgtgcagcggagacggcccgcacggcgtatatcggcttcgtccgcagcgaggcggcccacagcgtcagtaaaatttgagccgggcaggacccggagagaggatggtacataagatgaaaaccctggaggaagtgctgtacgattacaccagaggagagaagactctggaggaggccaacaaggccctgaaggagctggggtgcgggctcaccctggaccccacccgcaatctcttctccgcccgggagctgctggagacccgggcgggagagacgccggacgaggccaacggctggggcattctggaccacggtgtgggcagcctggaaaaggtccatgtggtgaacggccgcacggtggacgtggacatgggccaggagaccgcctatgtctatatgcccggaaagcgataccgcctgcggggcgatgtgctgacggaggaggactgagatggagctgctgacacagcgcttggccagcctgctgacggtgaagagtctggtgacggtgattctgacggcggtatttgctgccatggccggaacgggccgggtgaccgcggagcagttcttgaccgtgttcaccgtggtgatcgctttttacttcggcacgcaggcggaaaagcgggcccgggaatgagcgtggggacatacagccttgcccgggagggggacaagctgctgtccccccacttccgggtgcgggagttcgcctgccgggacggggcagacctggtgaagatcgacacggatctggtggagctgctggagcggatccgcactgccgcctgcggggcggtgaccgtcaacagcgggtaccgcaccgcttcttacaatcagaaggtgggcggcgccagagccagccagcacctgctgggcagggcggcggatattcaggtgagcggtgcctcgcccctgctggtggggcagatagcggaatactatctgggcggacacggtgggatcggcgtctatcagaccttcacccatgtggacacccggaccgcacgagccagatgggaccagcggagcggacgggaggtggccgtctccggctggcccggctggcggcccaaggaggaagcagtcatggacaacatccccagcgcgtatgcggaggaagcagtggcctgggccgtggaaaacggccttttgcagggcagcgaggcggggaacctgatgctctcccagcccgtcacccggcagcagctggcagcggtgttgtaccgctttgcaaagctggaggggcagacctgatacattattaaaatatagggtttccagaatgcggcggcgtttccgggcttttccggaaacgccgccgcatgattccgcagatttcacaaatgctagagccggggtgattgtatgcggcaggcacaagctccgcagaggaagtcccccagccgaacgcccgccctgcggatcgagccggaaaagcggctctgtccggcctttgacccggtcagcatcgccaccttcccggtggcggagccggaagagatgggctatcgggtgctggacaacttctgtgaggagcatatccagtaaacggaggagccgtgtccgggcgctgcctggatgcggctcttctgtcaggaagttctgtttgtcatgggcgcggaatcatggtacaatggctgtaaggacagccgctggatttcacggcacggcggccgcgtgacatctcaatgaacaagacggggagtggacccattgaaacgatgcttcatttttgccgcaggcacctattacggcctgcgggagcggccccagacaggggacctggtgctggcggcggatgccgggtatctggcctgccgccaggcggggatcaccccggatctgctgctgggagactttgactccatggatcagcccgcggactttgaccatgtccgccgggtgccggtggagaaggatgacacggacaccatgctggctgtgaagacggggctggagcagggctgcggcgagttttacatttacggcggcaccggcggcaggcggctggaccacaccctggccaatctgcagacactgctgtatctgcgccgccatggggccaggggatacctctatgacaatgattttgtgtggacggctgtggagaatgagaccatcactgtggagcagacggtggagtggggcctgctctccgtcttctgcctgggtgcaccggcctccggcattgacgagaagggtgtgcagtatcccctctcccacgcctccctttcggcggagttccccctgggcgtcagcaaccacatcatcgagcccaaggcccggatcaccgtccggaagggcgccctgatcgtggggtgggagctgccgtctggtggcgttgtttccgagataaaatagcgtgccggacaaagttcagttgcggcggcaagaaagttattgtataatagagacagcggaaaggtcgacctttccgaaagaacaccgatgaccgtgggaccagggttgggcacggcagtcaaggaggaacttgccatggcaaaatttaccgtgaacggccgggccgtgacagtggaaaacaaccagaagctgctccgctacctgcgggataccctgcatctcaccagtgtaaaggacggctgcagcgagggcgcctgcggcacctgcacagtgctgatcgacggtaagcccaccaaggcatgcatcccccagaccgataagctggagggcaagtccatcgtcacggtggaggggctgaccgattttgaaaagcaggtctatacctacgccttcggcatggcgggggcggttcagtgcggcttctgcatccccggtatggtgatgagcgccaagggattgctggatatgaatcccaatcccacccgggaggaggcggcctacgccatccgaaacaatatctgccgctgcaccggctatgtgaagatcattgatgcgattctgctggccgccgagctgttccgcaagggcgaggtgccgccggctcccgctgattggtccctggggcagcgggtgccccgggtggacgtggaggagaaggtcactggcaccggcatctatcccgacgacatctatctggacggcatgatctacggcagcgccgtccggtcccaatacccccgggcccgggtgctggccatccacacggaggaggccagggccctgcccggtgtggtgggggtctttacggcggaggacatccccgggcagaacaaggtgggccatttggtgaaagactgggacaccatgatcgccgtgggggatatcacccattacttgggtgacgccatctgcctggtggcggcggagacaccggagatcctggcccaggccaaggccctggtgaaagtggactatgaggagctgcccatggtccgcagtccccgggaggccatgctgccagacgctcccctggtccaccggaccgggaacctgctgacccacaagcacatccagcggggcaacccggcagaggccatcgccaaatcgaagcatgtgctgacccagcacttctccacaccctggacggaacacgccttcctggagccggagtgcgccgtggcctatcccgacggggacggggtcatgatcctctccacagaccagggcgcctacgacacccagcacgagaccatggggatgctgggattgccggcggaaaaagtgaaggtccgcaactgcctggtgggcggcggcttcggcggcaaggaggacgtgacggtccagcaccacgccgccctgatcgcgtacctgaccaagcgcccggtgaaggtgaagctcacccgggcggagagcattctgatccaccccaagcgtcaccccatggagatggagttctccatcggctgcgacgagaacggcatcatccagggcgtggccgccgaggtcatcgccgacaccggggcctacgcctctctgggcgggccggtgttggagcgggcctgcacccacgccgccggtccctacaactaccagaattttgagatcgacggctgggcctattataccaacaaccctcccgccggggccttccggggcttcggtgtcacccagacctgcttctgcatcgagagcctcttaaaccagatggcggacatcgtgggcattacccctgggagatccgctaccgcaacgccattcgcccgggacaggagctgcccaacggccagatcgtagacaactccaccggcctggtggagacgctggaggcggtgaagccctatgtggagaataaccagtacgtgggcctggcttgcgccatgaagaacgccggcgtgggcgtgggcatcccggacaccggccggtgccgcctggtggtggaggacggcaggctccacatctttgccggtgcctcctgcatcggccagggcctgggcacggtgctgacacagatggtctacgagcagacgggcattccccgggacaggatcgtctacgagcggtccaacacctactgcgcgccggactccggcaccacctccggctcccgccagacgctgttcaccggcgaggcggtccgccgggcctgccaggatctgaaggaggccatgggggcctccggcggtctggacgccctgaacggtcaggagttctatggcgaatacctgggaaagacggaccctctgggggccccggtgcccaaccccgtcagccacgtggcctacggctacgccacccaggtgtgcatcctggacgacgaggggaaaatccgccagatggtggctgcccacgatgtgggcaaggccgtgaatcccctgtccatcgaggggcagatcgagggcggcgtggtgatgagcatgggctttgccctgacggagcggtatcccctcacggactgcaggcccaccgccaaatacggcacgctgggcctgttccgggccaaccagatcccggagatcacccccatcatcgtggaaaaagcgggactgaacgtggcctgcggcgccatcggtatcggcgagatcacctccatccccacagccccagccattgcggacgcctactaccgctacgacggcaagttccgtaccagtctgcccctggagggcacgccttacagccgtaaataacaagcgccgcggcggtacttccgccgcggcctgtccgaatctgcgttacccccgctctcgcactgtcacatggacggtgtctccgggctgcttcccgatttgggcccggatgtccttgcgcatccccaggatgtggccgggagtgcccatccgcaccaggctccccgcgtaggggacgccgtcaaaggtggcagccaccttgactcggcccttaccgaatagcgcctgtacgtcatgggggaattctacataggctccgtcgatgtccggaactttccggatcaccgcatcgaattcatagacggttggattcatacctgctcctccgctttcaattcctccagggcttgggcggtatccacgtcgcggagctcctccgccgggacgtccagaaggaggagatccgcctcgtgccgccggataacggtgttgccgccgtggtcctcccgcagctccagcagctccggaaagaaccgggcagggaagaggcagggattgccccgcacgccgccgtggcccagagcgacgatcttctccggccgggtgcgccagcggtccaccagctctgccacgctctcacgccgcaggaggggctgatcgctcacctggaacagcaccccgtcacagtcccgcagagccgtcaggcccagttcgatggtgtggctgatgccgtaatccgggtggggattgtggatggcggcgaagtggaactccccggccagccgcatgacctccgggtattgagtcaccaccacgactttgtcaaacttctcggccgggacggcttccagcgcccggaggatgagactcctgccccgcagctgggcggccagcttattttccccaaaccgccgggcgttgccggcggccatgaccacacaaccgattttcggcttgttttccacatccatcacctcattttatcagtagtatatccgctttcgccgtgtccagtcaatgggcggcggaactttgatcaaaaaaggaggcttgcctgatgagcaaaagcgtcggcaaaagcgtcacccgtgtggacgcctatgaaaaagccacgggccgcgccaagtatgtggcggacctgtgcgatcaaagcgccctggtggccaggatcctgcacgccaccatcgcccacggctacgtgaagtccatcgacactacggaggctgaggccgttcccggtgtggtgaaggtcctgacttgcttcaacgtgcccgattaccgcttccccacagcgggacacccctggtccacagatcccgcccaccaggacgtggcggaccggctgctgctgaaccgtcacgtgcggtattacggcgacgacatcgccgccgtcatcgcggagaacgagatagctgccgctcaggccgtccgggcgctgaaggtggagtatgaggagctgcccttcgttctggacgtgcagaaggccatggagccggatgccccacagatccacgaggactgccccggcaatgttctgaagcacacagatatccgcagaggcgactatcagaccgccatccaggagccgggcctgatccgggtggagggctggtacgacacccccactgtccagcactgccacattgaaaaccacggctgcttcgcctatgaggaggcgggccgggtggtggtggtcacctccacccagatcccccacatcatccgccgggtggtggggcaggcactgggtctgccctggggcaaggtgcggatcatcaagccctacatcggcggcggctttggcaacaagcaggacgctctgtacgagcctttgtgcgcctggctctccacccaggtggggggacggctggtgcatctggagtgtagccgggaggagacctttgtctctaaccgggtccgccacgccatccgcacccacatcatctcctacgtccggccggacggcaccctggtggcccggaagtttgaggcctggtccaaccagggggcctacgcctcccacggccacagcatcgtggccaagggcatgggcgccttcccccagctctacccctgcgacaatttggagtgcgactgctggacggtctacaccaaccgccccgccgccggcgccatgcgtggttatgggatccccaggccatgtgggccggggagtgccacatcgacgatatctgtcaggctatcgggatggagcctatggaattccgccggaagaatctgatgccggtggggtataccgacggcttctccagaaacgagttgtacgccgacaccttcaaccagtgcatggacaagggaatggcgatgctggattaccagcggaaatatcgggaataccagaaccagactggccctgtccgtcggggcgtgggccttgcggtgttctggtacaacacggctgtgtggcccatctcgctggagtcctcctcctgccggatggtgctgaaccaggacggttccctccagttccagaccggtgagacggagattggacagggctgcgacaccgcctattcccagatggtggcggacgcggtgggtatcccggtggaggacgtccatgtggtgtccacccaggacacggacgtgacgcccttcggcaccggtgcctacgcctcccggcagacgtacatcggcggcttcagcatcatgcagacggctcaagcattgcgggagcggattctgcagatcgcccacgagcagacccggatgccggtgtctgttctggatctggtggacggcaagatcatccgcaaggaggacggccgggtcctcaagactctgggcgagctggcaacggagagcctctactccctggagcacagtcagcacatcaccgccgagaccacggcccagatcaagtccaacgcctactccttcggctgctccttcgcagaggtggaggtggacgtccctctgtgcaaggtgaagctgctgaatctggtcaacgtccacgactgcggcaccctcatcaacccggcgctggcagaggcccaggtccacggcggcatgtccatggccatcggttacggcctcagtgaagagctgaagttcgacgagaagaccggaaagcccctgaacaacaatctgctggactacaagctgtccacctttatggaccatcccacgctccaggcggcgttcgtggaaaacccggagcccacctctccctacggcaccaaggccctgggcgagcccccggcctgttcgccggcgccggccatccgcaacgccatcctgaacgccacaggtgtggcctttgacgcatgccctatcacgccccatgtcctctaccgcggattcaaagaggctgggctgatcgaagactaaaggagggaaccactcatgtatgatatgaaagccctgtatcaggcggagagcgttcaggacgcggtggccctccgggtggcccatccggatgcccagatcatcgccggcggatccgacgtgctggtgcagatgcgggagggcaagcgggccggggtggagctgatctccatctacgggctggatgaactccggggcgtgaccctggaggcagacggcaccctgcggatcggctccctcaccagcttttccctcattacccgggatcccctgatccagaaatacctccatgttttgggagaggccgtggaccaggtgggcggtccccagatccgcaacatcggcaccatcggcggcaacacctgtaacggtgtcacctccgcggactccgcctccactctccacgcctacgacgccattgtggagctgacgggaccggacggtatccgccgccagcccatccgggagttctacatcagggcaggcaaggtggatatccgtcccggcgagatccaaacggctatcctgatcgaaaaagacagttatattgacacatttggccactatataaagtatgccatgcggaatgccatggacatcgccaccctgggaacctctgtgaacgtccgcctttccgccgacaaaaagaccgtggagcgggcgagagtggccttcggcgtggcggggccggtgcccctgcgggcggcggctgcggaggagctggccgccggacagccggtgagcctggagctggcggatcgctttgcccaggcggtgaaggaggacatcaatccccgggactcctggcgggcggccaaggatttccggatgcacatcgcggtggagagcgcccggcgggcgttcatcgaagcggtgaagctggcgggaggtgacctgtgatggaaaagcatgtgatgcagtatcagactgttcacttcaatctgaacggcaaggacgtggaacgcacggtggacgtgcgggccagcctgacggacatgctccgcaacgacttccggatgacctccgtgaagaagggctgcgaggtgggggagtgcggcgcctgcaacgtcctgatcgacggggaggcatacaactcctgcatttatctggccgtgtgggcggagggcaagcacatccgcaccctggaagggctgctgggccctaacggcgagctcagcgacatccagcaggcctttgtggacgaggcggccatccagtgcggcttctgcacgccgggctttatcctgacggcagtggagatcctggagagcggcaaggagtacacggacgatgaattgagaaaactcctctccggccacctgtgccgctgcaccgggtatgagaatatcctccgggcggtgaaaaagaccatgtacaagcgcctaggcaagcccatgccggaggcgtgagatcttcaaaagcaacccggccgcgcacagcggccgggttgctttttgggggatgcgcggcagaacggttttcttttcccgggaattgtgttatactggcaccagatgaaaaaggggagggaatgccatggcccgcaagacctatacggaggaggaccgggcccgggtgcggcaggctctgctggacacggggctgaatatggccgtaagcaagggtctgaaggggctgcacttggcggagctcgccgcggcggtggggatttccaagccctatttctacacgttttttgactcgctggaggatttttccctccagatgatggaggagcagcgctgccgtctgctccggctgctggaacaggagctggcccggccggaggggacctgggaggagcacgtggagtcttttttccggacgatcctccgccaccgggaaaacggcatcctggtgatgacccagggggaggaggcggatctgcacagccgcctgacgccggagcgattccaggatttccggcccgggcagcgggatttctttctgcgcctgatggcgctgctggacatccggcaggaggactgcgcccctgaggtgctggcgaacctggtgttctcctgcctcctgatctataactccgcgccggaatccatgccatttctgtttccttcgcacctggaggagacggcggcgctgcacgtgaaatttttggtgaactatctgggctccctgcgcaacgcaaaaaaagaccgctgatgggcggtctttttttgtgcgctgataattacccagttgcgcaatccggtttcttttggtatgatatctcatatattgaccagataaaataaaatggtcaatataaaattgagatattaaagagggattgtcatgggaattttcggaaaactcttcaagggacctgaaattgaccaggccaaaagcgcggacagcaagcagaagatgcgccgcctgtttgacagcgtggtgcccgacggcgggcagtaccagctggtggccgcctatacggaggatgcgaagcggttcaactacggcctggtccacggcagcaagactacctacggcagcctgatcgtgggctggaaggagggggcggaccccacggtggtggtcgtgcccacagttccggacctctccggctgcggcgatccggaaatctgcccccgttccgcagtcaaaaaggcctatcagaataagtaccccacggacgccttcatcatctacccggatgggcgtcactatctggccatcaacaccttcgagtggctggaggatgagaagctgttcatctacgtggaccagggaccggaagagcaggcctttgagactttcttcaagacctgttacgccacgaagtgaggagcgcgtgccatgtcgctttccctggagcaggtcggtgccgtcctgctggccctggtgattctctttgtggcgggacacctctggtatgcactggtggagatggtgaaggatgctattgcccgccgctttttttccggaaaacgggagccctggcatccccttccgccggatgagggcgattccggcgacggtccgcccggtactgtttgacggcggcctcttcttgcggtataataaaaccaacaaggagaggagggttctctatgaaaaccatcatcaccatcggccggcagtttggcagcggcggcaaggagatcggcatccgcgtggccaaggagctgggcattcccttctatgacaaggagctgctgcaggaggccgccaagaagagcggcctgtgcgagaagatttttgaaaacttcgacgagcggcccaagagcctcctgtactccatcgccatggattcctatatgtttgccctgcccggcagcggtgtgggtgactctctggaacaacaggtgtatctggcgactttcaacaccatccggcacatcgcggaccaagggccctgcgttatcatcggccggtgcgcggactacgccctggcggactatcccaaccacctgagcctgtttatcagcgcacctctggaggtccgtatccagcgcgtggcccagcggcagaacctcacgccggagaaggcccgccagctgatcctcaagaccgacaagcgccgggcgtcctattacgagtactattcctccaagaagtggggcagtgtggacagttaccacttctgcatcgattccagctatctgggcctgggccggaccgtggagctgatccaggccatggtggcccacaaggagcatccgatccccagccccacggaggaggatcccacccgtccccggacgtaagcgccgcaaaacacggagggaccggagccgcacaggctccggtcccgttttcctgttcagagaggataactcctgggcaggcacggcggctcacgccgcaccgggtcatggccgatggtccagatcccggtagaagcggaaggcatcctcgaatttcccctgggcgtaggtgcccacatcggcgcagtaggcctcataggccgccagaaggcgctccgcctccggcgtcagcaccgcgccgccgccgtgggcacctccgatggtggaggagagcagcttgcacccaaacactgtctcagctgtgcggatgatacgccacgccttggagtaggccatttccatagaggcggctccggcccggagggagtggtgctcccgcacccgctgcagcagggtggcgatgccggggccgaagcagcgctggtcatcgtcgctgtaaatccgcagcgtcactttcaaatggagctcattctgtgccatagggcgcctcctctgtttctgtcccaatcccccgccgggaccgtccggacacccatccggggcccgacctgccgggcgagaccccaataggctgaggacaggggtgccggggtcccggacgggagatcatgtccctccgaagcgatattctgcttctatcatatcacaggatttgcggtttgcaaacctggaaaaatgtgatacaatccaatgcaggggagtgacccgctctgtgcgggaaggaggaactattatggagaaaatcagactgggccgtaccggcctgctggtgaccaagacggcgttcggtgccctgcccatccagcggatttccaaggcggatgcagtgaagctggtccgccgggcctgtgaggcgggaatcaactatttcgacaccgcgaatatgtacactgacagcgaggaaaaactgggagaggccctccacgacgtgcggcagaacgtggtgatttccaccaagagcggcggaggagacaaaaagacggtccaggcccacattgagcagagcctccgcagcctgcggacggattacatcgacctgttccagttccacaatccggcggtgctgccggatatccatgacccggacgggccctttgccgccgcactggaggccaagcagaagggctacatccgccacatcggcatcaccaaccatcggctgaaggtggcccacgaggccattgagtccggcaattttgagacgctgcagttccccttctgctatctggccacggagaaggacctggagctggtggagctgtgccgggagcacgacatgggcttcatcgccatgaagggcctctccggcggcctgctgaacaatgcggaggcctgctacgcctttatgcaggagcatccagacgtggtgcccatctggggcatccagcatgagtgggagctggaccagtggctggagctgacggagcggaatccccgcatgacgccggagctccaggcggtgatcgaccacgaccggacggagctgtcgggggacttctgccgctcctgcggctactgcctgccctgcgccgccggcatcgacatcccccaggcggcccggatggcccagctgctgcggcgggcaccctacaagccctatctgagcgacgagtggcgggagaagatgcaccagatcaaaaactgcatccactgcaacgcctgcaagtcccgctgtccctatgggctggacaccccggccctgctgcagaagcagctggcggactacgacgcgttttacgccgcccatcacaacgactgaaaaggagaaccccagatgctcttccgcaatgaggagtccagcctgaggctggatatcgtgaactatgaatttccgccggacggcggcgaccccaccagtgacgaccggaactggctggtgctccgggccacttggaacaaggaggacggagacgtggtgaaggattccaacagctgcctgctgacccacgagctccagagcatgagcgccgggctgaaagtgctgaaggctggaatccgggatgtgtacgtcagtgactttcaggagaacttttacttctccgtcggcgcccgggcattgggagacgggacctttgaagtggtggtgtccttctatctgcccaacaccatggacggggacgacaccgctgagatcacctgcaccatggaccagaaggagatggaggcgctgatcggcgaactggaccggctctgcgaaaaattcccggatcggacctgaaaaaccccggagccccggttggaaagaaggtgaacaggcttgaactataagacgagctattggctgatgcggatattgggcatcggcggcattctggtgatgctgatcggcgggatcaccggcagaaccgtcatcggcgtgctgggcatcatctgtgtgctggttgggacgcttcagatgaatttcttctaccactgcccccactgcaagcgggatctgcccaagcggaccctgcccaaaacctgcccctattgcaagaagcccctggactgaacggagggcggccatggactacaagaagagttatacgctgctgtgggtggggctgattgccggattcgtcctgatgctcatcggcgtgtttctggagattggatggctactgtggccgggagcggtggttgttatggcggatgttctccagacgctgctgttcttccggtgtccgtactgcggcggacactgggatccccggggcggcattccccactactgcccggagtgtggggagtacattcggtaaaaatcctgttatactggcaaaacaaggccgctctgcatttgcagagcggccttgcggctgtgtggaacaagcggcagtgtgttccatcagatgagggcgctgcttccgcggcgccctcatctggcttttcgttttttacttactctgccttggggccggcagctaccagagccttgcccgcctcgttggcggcatacttggagaagttcttcacaaagcgagaggccagatccttggctttggtatcccactcgccggcgtccgggtaggtgtcccgggggtccaggatggcggggtccacaccgggaagagcggtgggcacctcaaagttgaagtaggggatggtcttggtgggagcagtcagaatagagccgtccagaatggcgtcgataatgccgcgggtatccttgatggagatgcgcctgccggtgccgttccagccggtgttcaccaagtaggccttggcaccggacttctgcatcttctttaccagctcctcgccatacttggtgggatgcagctccaggaaggcctggccgaagcaggcggagaaggtgggagtgggctcggtgatgccccgctcggtgccggccagcttggaggtgaagccggacaggaagtagtactgggtctgctccggggtcaggatggaaacagggggcagcacgccaaaggcgtcggcggacaggaagatcacattcttggcgtcgggtccggcggacacgggtcgcacgatcttctcaatgtggtcgatgggataggaaacgcgggtgttctcagtgacggagtcgtcggcgaagtcgcagtggccgttctcgtccacagtcacgttctccagcagggcgttgcgcttgatggcgttgtagatgtcgggctcggcgtccttgtccaggttgatgaccttggcgtagcagccgccctcaaagttgaatacgccgttgtcatcccagccgtgctcgtcgtcgccgatgagcaggcgtttggggtcggtggacagggtggtcttgccggtgccggacaggccgaagaacagggcggtgttctcgccgttcatatcagtattggcggagcagtgcatggaggccatacccttcaggggcaggtagtagttcatcatggagaacatgcccttcttcatctcgccgccgtaccaggtgttcaggatgacctgctcccgggaggtgaggttgaagatggcggcggtctcggaattcaggcccagctcctgatagttctccaccttggccttggcggcgttgtaggagatgaagtcaggctcgaagttctccagttcctcagcagagggctggatgaacatattcttgacgaagtgggcctgccatgccacctccatgatgaagcggatggccatgcgggagtcgtggttggcgccgcagaacacatccatcacaaacagacgcttgttggacagctgctcctgcgccagcttcttgcaggcatcccaagcctcctgagaggcgggcttgttgtcgtttttgaactcgtcggaggtccaccacacggtatccctggaggtgtcgtccatcacaatgaacttgtccttgggggagcggccggtgtagatgccggtcatgacgttgacggcccccaggtcggtgacctgtcccctgtcatagccctccaggccggccttggtctcctcctcaaacaggaactcataggagggattgcggataatttccgtggtaccagtaataccatatttactcagatcaatggttgccatttgaatgacctcgtttctgaataatcttccagccggcgcggcggaggggcatttttcgtatcaatatcatacacggtgcgggagataaagtcaatctccatccgcctcccgccccagcgcggcggagagggccgcgaagtcctcaagcgtcagctgttccccccggacggcggcaggcaggcccatatcggcgatggcctgttggatggattccttgggaatccccggcagggcggcggagaggctgttggccagggtcttgcgccgcagcaggaagccgccccgcatcactttgaagaaaaagctctcgtccgctacatccacggcgggccgctcccgccggacgcagcggatcacggcggaggtcaccttgggagcggggagaaacttctccggcggcacgtcgaacagcagctccggcttcatgtagtactggaggaacagggagaaggagccgccctcagaggagccctgtggggcgcacagccgccgggctacctcccgctggatcatcaccgtgaaggcagtaaagcagggggactccaccagcttttccagaatgggagaggtgacgttgtagggcaggttggcgcagactataggcgtgaggccctggaacttctctgccgtgatggccgtgaggtccagtttcagcacgtcccccggcacgacctccacattcggatagggggccatggtctccgccagcaccggcagcagggcccggtccagctccacggccaccaccttcccggcccgctgggccaactccgccgtcagggggccgatgcccgggccgatctccagcacgccgcagcctgcgtccgcgccggaagcctccgcgatccggcggggcacctccggatcgatcaaaaagttctgtcccatggatttggagaaatggaacccatgccgggccagcaggtcccggatggtgttgtagtcacagagattcatacctgatcccgcctttcttcagcagtatatcaaatttttgcgggtctgccaaccccatcccggcgagggaatggtccttgcaaaataccgcctgatccggtaaactggtggcatcaaaaaatccccaggagggatgcagatgcgattcatttttctggacctggacgacaccattctggacttccaccgggcggagcggcaggcgctctcccagaccctgcggcactttcatgtagaccccacggacgccgttctggaccgttatcacgtcctgaaccgccgacagtgggagttgctggaagaggggaagctgacccggccccaggtgttggtccggcggttccagctgctgtttgatgagctgggggtccgtgctgctccgcaggaggtctgccagctttatgaggaacaactggcccagggccacttcttcgtgcccggcgcccaggaactgctggaggccctgcacacaagatatgagctgtatctggccaccaacggcactcccgaggtccagaacagccggatcgagagcgcaggcatcgcccgctatttccaaaacatcttcatctccgaacagatgggggcctataagcccagcccggccttcttccacgcctgctttgcggcgatcccggactttgatgcggcggaggccatgatggtgggggacagcctgacctccgacatccggggcgcccggaacgtcggcctgcggtcttgctggtacaatccccagtacctgccgccccggccggacatcccggcggattataccatcggggccctgccggagcttccacccctgctggagcggctgtgagcgcgattgaaaagaggtcccccgcttttggcgggggacctcttttcagaatgtgcctctgcgggcagtttcatcactccaggatatagacattgcacgtccgccgtccgaagttgatgcactgctgataggtgtcgtagtacaggtccacgatatttccccgcacgccagtatccgccgccacggcggtgccgtagaccacggagccgtcggccgccacgatatacatcttagtgcccagggggataacgttcttgtccacagccacggtgcccaccttgaccagagtgccggtggcggtggtgtagtcagcgccgccgtggcccgcggtgtaagcggtggcggtcatggacttcacgccggagaagttcagagtggtgccgtctgtcagggtcaggatgccgctgccgtcggcgtttttagagacgctggcgacgcccgccctggtggaagcgacggcggtgccgtactccacgacttcattcacggcggtgctctccagctcctccacgaactggcgggagatctcctcgccgccggaccagaccacctcatagatggaggtgcggacgccgtcggcgccctcctggaccaccttctccgtgcccttgggcagggagggattggccacccgcactgtctcgtaggtggcgggctcctccacctggtcgtaataggtcagctcggaggcaatggtcagctcggcgctgtcctcgtccagatccacggctaccatctccaggggactgggggtgatgtggagccgttccagcagctctgccacagtctcgctgcgggccttggcggtgacggtgctgccgtcgtgcgtgaccgtgacctcctgtccggcggtcagggccatgtcatagccactctggccgctggagaggtacaccagctgagaggacatctcgccctcccggacttcctcctcgttcagcacgatggcggcgtcctctggaccggtgagaatatacacggcgtttgcgtgatcggtgacgatccagctggtgcagacaacggcggccagcacaaagagctgcagaccgaaccgggccttgaggctgtgcagctttttctcaaaagcatgtgtgttcaaaatcagatacctcctcagaaaaggtcttccatgccagtcttccctggttttggaaggtctatacctcggtgttttcctgaatgaaaacaacttgtaacttttgttaccgattggaaaactggggctagtatacaccggcttcccacttttgtcaagtttttgtgggggttacggtgttatgtctcccactttgcagaaaaacaacgcggtcgagctgtgcaaaagtctggagaaaaaataaaaaaagtaacaaattggtgacataaaaccgacgcaaaaaaacaggccccgcgcctgtctgttcagacgcgggacctgttggggaaccccctctgttttcaagggattcagcggacctccggcgtgaagcccagatcctccagctcgctgacggctgtcttgacgcagttgtcacagccgtcgacggtgacagtcttggtgtccagagagacagagaacttcagctccgcggcggtgagggcgttggtgatgcgcttgacgcagttctcacacatcatatcagggacagaaatcgtagtcatattgagtgctccttttcatttcatcagtttttgaatggtgaccagaaggtcgtccacgacctccagatgtccgttttggatgtcctgcaccacgcaggagtgaatatggttgctgagcagctcccgggaaaaggcgttcagcgccgactggatggcggagacctgggtgaggatgtccgtgcagtagcactctttttccaccatgccccggacgcctcggacctggccttcgatccggttcagccgccggatcagggagtcgtactccggggcctcccggtgcttgtggcggcagggacagcctgccgctgtctcctccgccggtgcctcggcggcggggactgcttgcaaagtctgatcttccatatagaatactcctttttcccgtttcccgtcaaatcacagtttggcccggcccagccgcaatgcgttgcctaccacgcagacggagctgaggctcatggccgcccccgcgaacatgggggacagcagagggccgccgaaggcgaacagcaggcccgccgcgatggggataccgatggtgttgtagcagaaggcccagaagagattctgcttgatgtcccgcagggtcagccgggagagccggatggcccggggtacatcctgcaggtccgagcgcatcagcacaatgtccgcggactcgatggcgatgtcgctgccgctgccgatggcgcagcccacggtggcggcggtgagggctggggcgtcgttgatgccgtcgcccaccatcatcaccttgcggccctgagactggagccgctccaccacgccggccttctcctctggcagcacctcggcgatgacttcgtccacacccaccagggaaccgatgtgctccgccgccgcccggttgtcgccggtcagcagcacggtccggatgccctgcccgcgcattttctggatggcggcggcgctggtctctttcaccggatcggccacagagatcaggcccagcagggtgccgcccctggcgaagtacatgggggtctggccctgggcggagaggcgctccgcatcagatgccagagaggagacgtccacgccgtgctcctccagcaatcggcggttgccggccaggacggtctcgccgcccagcacggccttcaggccccggccagacaggttctcaaagctctccggccggacggtgccgccgtagccatgctcttgggcgtaggcggtgatggcgtttgccaggggatgggcggacaccgcctccaccgccgccgcggcggacagcaggtcggatgcctcacaccgatgggggaggacctccgtcacggcgggggtgccctcggtgacggtgccggtcttgtccagcaccaccgtgtccacgctgtgggtgatctccagaatctcgccggagcggatcaggataccatgcttggcccccaggcccgtgcctaccatgatggcggtgggagttgccaaccccagggcacaggggcaggcgatgaccagcaccgatgtgaacacccgcagcacaaaggagaagggctgcccggcgatggcccagatgacggcggccagcagcgcgatgcccatgaccaccggcacgaacacaccggccactttgtcggcggtcttggagatcggggctttccggccctgggcgtcctccacgaaccggatgatgcgggagagggtggagtcgtcgccggtacgggtcacctggacgtacagcacgccgttctcattgacgctgccgccgatgacctcgctgcccacggccttctccaccggcaggctctcgccggtgagcatggcctcattgacgctgctctcgccctgggtgacggtgccgtccgccgggacccgggcgccgggcttcaccagcaccacgtcgcccaccttcagttggctggtgggcacctcccggcccgtgtccgccaggatggcggtatccggggacagctgcatcagggcggtgatggcgcctttggtcttctgcatattccggctctctaggaacttgcccagggacaccagagtcagcaccacggcggcggactcataatagagattgtggacgtagctgggatcgtcggagatcagaaaggtcatcaccaggctgtacgcaaaggagcagccggagccgatggccaccagggagtccatgttggggttgccgtggaagagggacttgaagcccccttggaagaagttccggccgcagtacagcaccggcacggccaggatcagctgcagcaccgcaaaattcatgggatgggtgtgcatggagaagaggtccggcaggggcagagctggcagcccgaaaggcagcatctgccccatggacacatacagcagcaccgcggagaacaccgccgccgcgatcagctcgatcttccgccgcttcagggcggcggtctctgcatcctcagcattctggaccgtggcgggggccgggtgctccaggtgcagggcggcgccgaagcctgccttctccaccttggccacgatctgctcctgggtgcattgactttcatcgtatgcaatggtcatgataccggtggtgagattcacctcgctgcgctccacgccgggcagcttccgggtgacccgctccacggacgcgctgcacgcggcgcagtgcatcccggagatgtcgtatttttcttctcgcataggaacctccaatctgccggagagataccctccgggggtattctttctgagacctactatatacccctgggggtatttgtcaagaggggaattttcggctgtgaaaaaatgccgtggaatccggaaaaccccttgacaaccgggggaactatggtatgatgaatatgaaatctaacaaaaaatttgtgaaactaaaaaattttgtatggtgaggattatgagagattcgatcaaatgggtcgccaatcggatgcccaagagcgacgaccggcagctttccatcatgtccctggggaacgtggccaaggctcgattcttccacagcagctttccccagtattccatcacgcctctggcccggctggacggcatggccaagtacctgggcctgggcggcctgttcgtgaaggatgagtccttccgcttcggcctcaacgccttcaaggtgctgggcggctccttcgccatggcccggtacatcgccaaggagatgggcagggacgtcagcgagatgacctacgactacctgaccagcgaggcattccgccaggagttcggccacgccaccttcttcaccgccacggacggcaaccacggccggggcgtggcctgggcggctcacaagctgggccagaaggcagtggtccacatgcccaagggctccagccaggcccggtatgagaatatcgccaaggagggcgcccaggtcaccatcgaggaagtcaactacgacgactgcgtccgcatggctgcggcggaggccgccgagaccaagcacggcgtggtggtgcaggacaccgcctgggaagggtacgaggagatccccgcctggatcatgcagggctacggcaccatggccaatgaggcggcggagcagctgcggcaggtggggatcaaccgccccactcacgtgttcgtgcaggccggtgtgggtagtttggccggagcagtgatcggatatttcaccaacctgttccccaacgatccccccaccttcgtggtgatggaggcccgggcggcggactgcctgtaccagggcgccctggcaggggatggacagccgaggatcgtggaaggcgatctcaagaccatcatggcgggcctggcctgcggagagcccaacatcctctcctgggacattctgcgcaaccatgtctccgccttcgtctcctgcccggactgggtcagcgcccggggcatgcggatgctgggcgtgccggtgaagggcgaccccacggtgatctccggcgagtccggcgcggtgggcatgggcctgatcgcggccctgatggagacggacgagtaccaggacctgcgggaggccatcggcctggaccggttcagccaggtgttgctgttctccacggagggcaacacggatcccatgaagttccgcaaggtgctgtgggacggcgaatatccgacggtgtaaaaaagaaccgggggaagcattgcttcccccgatttgttttcggtttaggcggtgatgacggatgtgttgctgtaaagggtttcgctgccggaactgtcttttgcatagagcgcaaccgttgcatagtaacgcacgccgggtgtgccctggtagtccactcttctatatgcggctgaagtattcgtatcaattagaccacttgtatatgtttttacatcttcataagaaccattgctttggcgttcccaaattacaatctctgtagcaccaagtctatccataatatgagtggcattgatgtcaaattctacggcaaattcaccatctcctaaaggagttgccacaactctcgtatatgaaaaataatcgctagctctttgagattgagcacttgcagatactgtacccagaagtattacaaaagtcaaagtaaaaataattaaacgaatgaatttctgcttcatgtgaagactacccctattgtatagaatcgaccatctttttcaatccatcaaaagaaacgtggccttgaatgtgcccttcgaccaccccattcaaccaagctacactgtttgtatcattattactcattaaataataagtaatcccgtccacctcataaagttcgaatgagttactatcaatttgatatgtatcatcgtatttttctggtacagagtcataaatttgaattcgaattgtaaattgctcttgactgttttcgaatgttccttggagtctgatcataccaatttgttcaacaacactaatgcttccgactagttctgtatcttctggaaaccatgtgggaacaactgggagatcagttctttcagaaaccgctaaacgcagagtattatacggatcatcctgcggcgcttctgcttcctcctgccccggcgtcacaaatccaaaggtctccgcggtccagtccgcgaacgcctggaggatgtcgaacccaaaggcggaggcagcgccgcacagaatcacaatgcacgcggccgtgatgacggctgcccgcagaatccggcggcttttctttttgggggaaggggaggtgatttggtcaagatgggatgagtcacgttccgggaggacctcagtctcataggcagaagcctgtccttgataattttccttgaaatcccgccatgcggcgtccacgtcgacctccgccgccgggggattcgcatcccgctgcttcatcacctccataatcgccatgatgtagtccacgtccggctcaccgccgtccgcagccgtgaattcctgctggagcagagcctccagctcttcggtgcgcatttgttccaggaaaggatacgccgtatttcgatctgatggcatctccgggaacctcctctgtatctataatgaccgtttcggccccgcttgttcacaggggcggcgaaaaaacttttagtgccggttccactgtttgacgaaccgctcctttgaacgcttgacccgcatggccagggcggacttcttcaaccccatctcccgcgccagctcctcgtaggtgtacttctccagatagagcttccgcaggatctcgtactcctccggcgtgaggatgctggtgatctccgcccgctgctggaaatcatcctccggagaagcgggcatctcgccggcggcccggatcaggtgcttccgccagaagcggtcctctttcaggagctccaggaccttatagcgcaggacccggtacagccatcccgtgggcgaggcgctgctccaaagatctgcctgatgctcccaagcgaaggcgaacagctcctgcaccacctcttccgcacgcccggcgacggagacgtaccagcttccgccagtccgcagggcgatctccgcacagcggagcaggtccggatacagcttccggtagagggcttcaaatcgcggttcatcaaaagaatcgttatgcgccataggcgtcccccttctctttctatctatcggggtgccgcgccgccggagcgggccgcggtacgaatttgattctaacacaaattgccgcaggtttacaacttttttgcaagcgctctccgcagcacgggaaaaagccgccggaaccgcgaatgtgcggccccggcggcctggatggatcatctgcgctgcccggtcctggtctgctccacgatgtcgtccatgacctcccggctgacggcgccctggacgtagccgaagacgttgccctccgtgtcgatcatgaatgtggtgggataggcgctgatgccgtactggtagaagagcgtgcccgtctcgtccatcaccacgggataggtgtagccgttttcctccaggaaggcggtgatgtcttcggcgctgccctcctggccgatattgggcccggccacgcccagcaccaccagctccccggcgttctcgtcccagtcctcatacagggcctggatgtccggcatctccatcttgcaggggccgcaccaagtagcccagaagttcagaaacaccgtcttcccctggtagtccgagagggtgtgggactggccgtactggtccgtcagggtgaagtccggagcggggaccacggggatctcctggctgtccgccccgctgtgctcctcctgagaatcgccggagggggccgcctcttcgccgctgttcccggcgggctcttcctgcaccgtgccggagccggcagccagatctgcggagatgccgccggtggcgccggtgagggtcaggatgcccatgacgatcagcagcaccgcgccgatcttcaccgtgtagcgcaccacattctggtgggacttgaagaaatccagcaccgtgccggtgaagagtcccactgccaggaagggtagtacgaagcccagggtgtacacgccgatcagcagaaatcccgcagcggaggactctgcggaggaggccatcagcaggacgctgctgagggtggggcccacgcagggcgtccaggcgaagctgaaggtgaagcccatcaccagggccaccgccgggttcatagccagtttgttcagatggaaggggaggcggtgttcctgctccagcagcatggtccgcttgcccagccccagctggtacaggccgaacagcaggatgatgacgccgctggcccgggcgaaccacacttggtagttgtggaagaactcccccagggcggtgaggcccagccccagcaggaagaaggcgaagctgatgcccaccacgaaaaagagggtattgaggaagatctttccccggggatagcggcggacgccgtcctcgcccaccacagcggcgccgccggccagatagctgacgtacagcggcaccagcggcagcacgcagggggagaagaagctcagcgcgccctgcagaaagacagtgacggcggatacgctggtctcaatggaaaagcccatggggacatcctcctgaatatgaagtcatggcgccatcataccgggttttccggccgctgtaaagagggatttgccacatcttccgggaaacacggaagaatcctcttgacagcggggagcggggcggtcaagataaagagtggaaaacaagaccgcaacgggcggcagggaggcactttgcaatggaaatggtggatttgtacgacgagaaccggctccctctgggccggacggcggagcgttacgcccccaagggggagggagaataccgggtggtggtccatatctgcgtgttcgacagccggggccgcctgctgatccagcagcggtctcgggaaaaggccgtctggccggaggcatgggatgtgtctgccgccggcggcgtggatgccggagagaccagccgccaggcggcggagcgggagttccgggaggagctgggcgtggccctggacctgacgggagtgcggccctcctgcaccgtgaacttcgacggcggctttgatgacttcttcctggtggagcgggaccttggcctggaggagctgacgctccaaaaggaggaggtggcccgggcccgttgggcggagctgccggaaatcctggacatggtggaccggggggagttcatcgactatcccaaaagctttctggcgtttttgttcgacatgcgggggaccttcggcttctgcaccaaatgaagctccgcctggaccgaagcttcagtgctttttcggaaaacggccttgacaggggacgttagacatggtataaacaaaacatactgatggtatgtatataaggggggaccggtatggcccgaaacaagcacccggaggagacggtggaaaagatcctggcggtctccgcgaagctgtttatggaaaagggatatgagcacaccaccctccaggacatcattgacaatctgggaggactgaccaagggggccatctaccaccacttcaagggcaaggaggagatcctccttgccatcgcggaccggatgggagagcagacggaggcctggatgcggacggtccgggacgatcccggcctgaccggagcggagaagctgcagaagatgttccgggcatccctggagaactcggaccagacggacctgttcgtgctggcgcccaatatgctgaagaaccccaagctgatgagcatcctgctggagagcatgatcggggaggtcctgcccaactacatggagcccgtcctgcgggaggcggtggcggacggctccatccggacggactacccggaggaactgggggagctgctgcttctcctgtcaaacgtgtggctgaatcccatgatctaccctgccacgccggagaagacccgccgccgcatggagctatacgaccagatgctgcggagcatgggcctggacctgctggatcaggagctgttgaatcagtgggagcgattttgccgcctgtcccaggaacggctgtaaacaacagaagaaactgcccgacagggcagcttctttttcacataaatacataccaaccaaatgtatgaaaaggaggagcgtatgagacaaactgatcggctcctgccccaggacctggccgcctgtctgtggctgctgggtctggccctgctggcaggagagaacgggaggaggaattgagatgcgggaaaagctgtttcaccgggacttcaccttggtggtgattggacagatcatctccctgctgggtaacgccgtgctgcgattcgtcctgccgctgtatctgctggacgtcaccggttcccggagcctgttcggcctgtgctccgccgcggcgttcgtgcccatggtggtgctgacgcccctgggcggcgtggtggcggaccgtctccataagcagcggatcatggtggcgctggacttcttcacctgcgccctggtggccctgacggcgctggccttgggacatctgcccctggtgccggtgctggtggcggccatgatgttgctgtatggtatctccggggcataccagccggcggtgcaggccagcatgcccctgctgtgcccgccggatcggctggtggacggcaacgccgtcatcaaccaggtcagcgccctgtccagcctgctgggaccgctgctggggagcctggtttacggtgccttcggcgtgacaccggtcctggcgggggcctccgcctgcttttttgcttcggcggtgatggaactgttcatccatatcccccatacgccaagacacactggagccagcgtctggcagaccgccagagcggatctggcggagagcgggaccttcctctggcaggaacggccggagatcctgaagtacatcgccctggtcagcgccttcaacctgctgctgagcgcgctgctggtggtgagtatgccggtgctcatcaaacagaccctggtgctgggggacacctggtacggcctcaaccagaccgccatggcggcagggagcctggccgggggcctgacagcgggactgctgggtccccggctgacagtccgccggtcctggctgacgctgctggcctgcggggtctgcctcatccccatggggctctgcctgctggcaggcgtgggggctgtcgcggcctttgctgtgctgacggctgcgggcttcgttctgatggcttgcgccgcgctgttcaccgtgaccatgctggcccacattcaggctcagacgccggccacgctggtggggaaggtggtatctctgctgctgaccgtctccctatgcgcccagccggcggggcaggctctctacggggtcctgttggagcagctggccgggggcgagggctgggtgctgctgggcgcggcctgcggggccatgatcgtcgctgcggcggcccggcgggtggcttactctgccgcctccggctccagcaggtgcatggcggagacctcgtaggccacccgttcctgggcggtgccgtcctccaggaccttgcggtaggtccggctctggacccggccttccaggctgagcgtgtcccccacctggagccgggccgcctggaccgccagctgtccccaggcaatcaccggcagatagtccgcccggccgtaccggcggctcaccgccagcatcaggtcgcagatgctgcggcccagaggggtgcggcggaagatggggggcttgcacagggcgccggagagcagaatgcggttgcagggctctccggacccgggttccatggcttgggcatacaccgtcagcaccagccgattcccaacgccggagcggttgttgaaggaccgcagctgcccccggacccggagcgggtcctccagccgcaccgcagtcagcagggcctccggcaccagcaccggcagcgtgtccggagtgccggagagccggggcacctgcaggggaaagcgataaaaccgggtgccgtggttttcatgggagagtgcaggcgcctccagagcaatcccctccagcagcacctcgttgcgggtctgagtcgtcatgttgtccacctctcggtcgtgatggtacaccttatgagagccgcggccgggatagacctgaaaatccccggcggcggaacaggtccttgcctccggggcggaatgcgtatataataaagccatgaatccggcggcccaccgccgttccacaaggaggggaagcgatgaaagccattgtctacacatcccagaccgggcacacccagcggtatgcccagatgctggcggaaaggaccggcgtgccggcatacagcctgaaggaggccggaaagagcttgcggcggggcgaggagatcttctacatgggctggctgatggccggcacggtgaagggcctccagagcgccatggaccgctataccatccggggggcagccattgtaggggtctcgcctcaggggaacggcgacctctggaccgaggcccggatcaacgggggatacagcgacagcggcgggcggctgttctatctccagggcggctacgcaccggagaagctgggctttttctatcgcatgatgatgaagcccatggccggctccgttgtccgtcaggtgcaggcccggggagaggccgccacggaccaggagcgccggatggcggagatctttcagcacggcggcgactttgtccgggaggaggcgctggatgagatcgtccgctggttccgggagggcccccacgacggagaggtgaaagcggtccccagcgtggacatttgaacctgacgaaaaaggccccggctgtccaaaaggacagccggggccttctgcatacgtgaacagcagcggaggactcagactctggccacgccggaggcgcgggcggcctgctccacagcggaggccaccgcgtcccgtacccgtggatcgaaggcggcggggatgatatagtcggcagagaggtcgtctcccactagctccgccaaggcatgggcggcggcgatcttcatagcgtcgttgatgtcgctggcccgggcatcgagggcgccccggaagatgccggggaaggccagcacgttgttgatctggttgggatagtcgctgcggccggtggccaccaccgccgcaccgccggccttggcgtcgtcggggaagatctccggcgtggggttggcgcaggcgaagatgacggctccagcgttcatggtctgcaccatctccttggtcacggcgccgggggcggacacgccgatgaacacatcggctcccgccagcacgtccgccagggagccggtccgcttctccggattcgtcacctgggccatctcctccttgatccagttcatgccgtcgctgcggccggcgtagatggcgcccttccggtcacagagggtcacgtcccctgccccggcggagagcagcagcttcgtgatggagacggcggcggcgccggcaccgttgataacgattcggacatcctccagccgcttgcccaccactttcagggcgttggtgagccccgccagggtgatgacggcggtgccgtgctgatcgtcgtggaagatggggatgtcgcaccgctccttcagcttccgctcaatctcaaagcaccggggggcggcgatatcctccagattcacgccgccgaaggacccggccagcagggccacggtgttcacgatctcgtccacgtcgtggctgcggacgcacaggggaatggcgtccacgccgccgaaggccttgaacaggacgcatttgccctccatgacgggcatccccgcctccgggccgatgtctcccagccccaggacggcggagccgtcggtgaccaccgccacggtgttccaccggcgggtcagctcgtagctcttgctgatgtccttctggatctccaggcagggctgggccacgccgggggtgtaggccagggacagcgcctccttgctgtccacctgggcccggggcgtcacctccagcttgcccctccactcggaatgcaggcgcagggattcctttgcgtaatccatgatcggtactcctctccataacgctcaaaagttgtttttattgtacgggaaaagcggacggttgtcaatttccggtgccggcggggcggggaaaatccaagcggtctcttgcattccggaagcgcctgtggcaaaatagatgggacagaaaaggaggcggtttcgtgaagatttcgaccaaggggcggtacgccctgcgcctgatgatcgatgtggcggtccacggcggggaggagttcgtctccttgaaggatgtggccgcccggcagggcatttccatgaagtatctggagcagatcgcgggtctgctgggaaaggcgggattcctccgcagcgggcgtggcgccctggggggatatcgtctgacgaaagcgccggaggagtataccctgggcagtatcctccggctgacagagggaaatctggccccggtggcctgcctggagacggaggagaacgcctgcgagcggtgcggcgtctgcccgaccctggacttctggacgggcctgtatgcggccgtgaacgaatatgtagaccgcttcaccctggcggatctggtgcgggaggaattggagaaacaggggagagcgtcccgaccctccacagactgaatggcaaaacgccggcctcatatagaggccggcgtttgtttgaaaagcaggtcagtccgtcagcccggcgcagtcggcgggccgtccggagagcatctccagcccgtgggcgagcgcggggaggacggcctccaggttttccctggccgccttgggagagccggggagattcacgatgagcgtccccttccggatgcccgccgcggcccgggacagcatggcccggttcgtcacctgcatggaggcgtagcgcatggcctccggaatgccgggggtcagccggtcacacacggcgagggtggcctccggcgtcacatcccggggggcgaagccggtgcctccggtggtgacgatgagatccaccggctcccggtcgcaccactgccgcagggcagcctcgatccggcccttctcgtccgggacaatggcggtctccgtcaccgcgtacccggcgtttttcagaatttccacaaccagaggcccgcccgcgtcagggcgctctccccggaaactccggtcgctgacggtcaggacagcggctttgaacatggtagatcactccttcacgattccagcagcagaatggcctccggcggaacggagacggtgaggcggtccttgtccggcaccgcctgccagttgtccttgtccagctccatccgcagcaggggcgcctccggcgccgcgccctccggccgcagcagcacgatggtggaaaacacgtcctccaccacctttactgccgtgcaggagaaggcgttttccgccccgggaccggccagctgaacatggtgggcccggatgccgatccggcagacgccctccggcaccggacggctgcaggagagcgtcagtccccagtccggaagaaacaccgcatcctcccttggccgggcgtcggcatagttcttgcagccggagagccgggcagcggcctctgtgccggggctgcggaacagctcccccagggtggtcacaggctgggatctgccccggtctatgacacacacccggcggcagttccggaacacctccccccggtcatgggagacccacagcaccgtgcccgggaatccgcccagtgtctctgccagctccagttccagctggtatttcaggtagctgtccagggcggagaagggctcgtccagcaggatggccgtgggctccgacgctaggattcgggccagggcgcaccgctgctgctgcccgccggagagctgccccggcttctggtctgccacggcctccagccggaactgccgcagcttctccgccacctctgtttggcggcgggccttgtcccgcacggctgcggcgatgttctgccgcaccgtcatgttggggaacagagcgtactgctggaacaggtacccgacctgccgccgctggggcggcaggttgattctggaggcgctgtcgtaaagggtaacaccgtccagctcgatgtgtccctcgtccggcgtcagaatgccggcgatgcacttgagggtcacagacttgccgcaccccgaggcccccagcagggccagcgtctcatccccggcgtcaaactggaccgccagatgaaaatttcccagggcctttcggatgtccacggaaagcgccattaccgtctgcccccttttccggcccgtttctggcgggcttccagcaggttcactgccaacaggaatacagcggagatggcaatgttcaccagcacccagcggagggcctctgtgtcattgtcggtccgccagagctgatagacggtggtggagatggtggcggtgcggccgggggtgtagccggcgatcatggaggtggcaccatactcccccagagcccgggcaaaggccagcacagtccccgccaggatgccctggcggcacacgggcatccgcacccgccagaagatccagatattggaccggcccagggtcgccgcagcttccgccagcgtaggatcgaagctctcaaaggccccccgggcggtacggtacatcagggggaaggccaccaccaccgtggcaaagacagcggaccaccaggtcatcaccagcctcaggccgaagtgggcctgcacccaggcgccgatggggcggttgggccccagcagcaccagcagcagccagcccaccacggtgggcggcagcaccaggggcagggtcagcaccacatccagcacgcccttcaccagccggggcagcttggcgatgtagtacgccgccaggatccccaggaagaataccgccaccgtggagatggcggcgatccgcaatgagttgtagagagggtaccagtccatttcaaaaaacctcctggggaaagggggcgtctgccatcccgacccgccagaggcgggccgccgcagaagcggcgtacaagcgttttgcaaagcaaaaccttggagaggccgggctttgcctggccgagcaaaatcaaatcaagggctcccattgggccaaggcccaatgggaacgatggcggcgatccgcaatgagttgtagagagggtaccagtccatttcaaaaaacctcctggggaaagggggcgtctgccatcccgacccgccagaggcgggccgccgcagaagcggcgtacaagcgttttgcaaagcaaaaccttggagaggccgggctttgcctggtcgagcaaaatcaaatcaagggctcccattgagccaagtcccaatgggaacgatggcggcgatccgcaatgagttgtaaagaggggaccaggccataaggttcctttggaaaataagaaatccggagtttggaatgaggggatcaagggctgtcagaaagcattttaaacgatccagccttatcagacgcctatttccaatctgcttgaactcacaccatggggctgaagcctaccgcctcgaagcaggccatggcctcgtcggtcgacaggaagtccaggaaggccttggcagcatcgggattggcgctgtttttcatgacggcggcggggtagatcacctggccgcacatctcagcggtggcctcgtccaccacggtcagaccggcggagaaggcgtcggtggcgtagatcacgccgcagtccacggtgccctcagagacctgggtggtgacctccttcacgttggagccgtaggtcagcacgccggaactggccagggtctcctcattcagaccgtagtaggtgaagatcttctgggtgtactggcccactggaacgtcgctgttgcccatggccaggaacacatcgccgctggccagcagctccgccagctggtcaaaggactcgatgcccttggggttgccctcgggaacggccagggtcaccttgttctccagcaggtccaggcgggtggcgctattcaccaggtccaggccctcggtgttctcctcgccgccctcggcgtccaactggttcatctgcttgggagcggcggagatgaacacatcacagtcggctccctcctggatctgggttttcagggtgccggaggagtcataagtcgccacgacggcgacttccggagccacggccttgtaggcctcgatgacctgatccagggactcctgcatggaggccgcggcaaagacgtgcagctctaccggttcggcggtggtctctgtggtgtcgtctgtggtgctgtcggtgtccgcactgccgctgcaggcggtcagggccagcgccatggacagggccagaacgagggagaaaagctttttcatggcgaaatcttcctttcttgatgataatatgttgaacccggctttgcaagtccggtgtcaaactgacgtgatattcaaatgaggataacggatggaaaaaacctgcgccggacgctccggcgcgggctgatttttactttccaaaggggcagatgggccagcggcagggctggcagccgagacacaggccgccctcccccagggagacgatccactccttggtgacgcttacatccgccgccacccagggcagcactaggtcgaagatggtggccccggcgtacatgacgcagccaggcaggcccatgacgggggtgccgtcatcgtagtagcccagcaggaacatagcgccgggaagcaccggggcgccgtaggtgacgatcttcgccccgctctgcctgatcccgccgggggtgttatcgtcggggtccacgctcatacccccggtgcagaggatgacttccgccccagtctgccgggcttgggagatggcgcctgccacgttctccaccccatcgccggaataggagacggagatggtctcgatgccataggcgctcaatttgtccttcaccaccggagtgaaggtgtcctggatcaatcccttcttcacctcgctgccggtggccacgatggcggcggtttttcgcacccagggccgtagctccagcaggggggtatctccggcggccgctttggcggctgtcagcttctcctccgcgatgatcagggggatcacccgcatccccgccagcttgtcaccttttttgacggctgtacccccttccgggtggcgatcatcagctcatcgatggcgtttaccgcccgcagggattccgaccggaccaggaacagcccgtcgcaggatgccttcagctcgatcttgccctccttgacgccactccgctccatattctcgttggcacacagggccagcaggcgctccgccccctcatcctcgtggagcatcccaggcgtcatctcccacacgtacaggtgctccttgcccatgccgagcagcaccgggatgtcctccggcgccaccacatggcccttgcggaaccgggcatccttgtactggtccttgatgatctgggtcaggtcgtggcacagcacatggcccaccgcatcctccgtccgtatcagcttcatgcttccgcctccagaatctcgatctcatcgccgggacggaccacgccctcccggaccaccacggcgaagataccctccgtgggcatgacgcacctgcccaccgcctgcttgatggcgcagtcgctgtggcactccttgccgatttgggtcacctccacctccgtctcaccgatccgcagatgggtgcccaccggcaggtgtttcaggtcgatgccctcggtgttgatgttctccgcaaacacccccggatccagtgggatggggcagctcgcccgcatggtgtccacgctctcctccgccagcagggagatctgccggtgccagtccccggcgtgggcgtcccccacgatgccgtggcggaactttagttggatttccgggacggggtgcttctgctcccccttccgctcgctgatgttgaccgataccacgtttgccaacaggctcactccttgatctggtaatctccgctcttgccgccggacttggacagcaggcggatgttttcaatgcgcatgtccttttggactgccttgcacatgtcatagatggtcagcgccgccacggacacggctgtcagggcctccatctccaccccggtaacgccggtgcaggtgacggcggcctggatctccaccatgcagggggaatcggacagggcgaaggtgatgtcgatacctgtcaggggcagggggtggcacatggggatcagctcccagttgtgcttggccgcctggatgcccgccacctgggctaccgccagcacgtcgccctttttcaaggtgccgtccttgatgttctgcaatgtctccggggccatgtggatctccccagcagccactgcccggcggtgggtgacggccttctccgtcacatccaccatcctggcccggccctgttcattgaaatgggtcaattccgccatggtggtcatcctccgatctgattcatgtttcggggcgtgtcgctggaccgttctgtgagatggtggcgctccggcttgtggaggatgccccgccggacggcgtcctccagcgcctggccgtggaggccccggagggggatctcttcccggctgtggaggcagcccttcagcttgccgtccgccgtcacccgaatccggcggcagtccgcgcagaagtcgtggctcactggggagatgagccccactgtccccagcgcgccgggcagctggtaccgccgggccacgccctgggcctcgatgggttccagctctgccatccggtccagcaccgtttctgcaggcaggaagcggttccgatcccacccggcgcaggggcccatgggcatcagctcgatgaaccgcatctcccagggatgctcccggctgagattcacaaaatcttcgatctcatcgtcgttgaacccgccgatgaggacggtgtcaaattttagattccggaatccagccgcctccgcagctttaatgcccgcaagcacgtcctggagggtccccagccgggtcatggcggcgaaccggtccggccgcagcgtatccaggctgatgttcagccggtccacccccgcatcccgcaggggccttgccagctggggcaggagggagccgttggtagtgaggcacagctccgccaacccggggatggcccgcagcatccggcacaggtccggcaatccccgccgcaccagaggctccccgccggtgaggcggatcttctttaccccgcaccgaaccgccgccgcggcgatctccgccagctcttcgatggagagaatatcgctgtgaagccgcttctccacgccctcgggcggcatacagtattggcaccggtagttgcacagatccgtgacgctaagccgcaggtagtcgattgtccgtccgcagctgtcccgcataatgtcctccaaccgtgatactcaagtgagataaacgatatactatattataagcgccctgcgggaaaagtcaagaaaaacgccccggccaatgtcggggcgtgaaccgaaaagtatcagcggtgagaggccctccaggcggcagccatccgcaccgacagcgtcaaggcaatggccagcaggatgagggaggcgatgcctgccataagaatcagagccatcaaggcccacatggaggtcacaggaatttccggtgctgagagcaagtcggcgatgggcgcggtcagcaatcggtacgccaggaattcaatccatagcacgaccagaatcactccattccgccgggtgggaggaaaggagaatgtgcagaaggagcggacagtcccaatcagcagagccagtatcatcagcgattggatccacgctgcaaaggtatagacgggggttccgacttcctcccaagagaacgtgaaaaagaaaagattccagctgatgccggtgccatagtagcaaaagattattgtgcgataataggactaaatcagaaagaccttgaaaaccaaggcattctggcttagtcccttctttttttgaccgaaaacaaaggactttcacaataatcaagcaagccggagggtgctgctgcacacttccggcagaaggaggatatagtgggtgctatcaaagtcttcttgaaggaggttctgcttccaatcgcgcttgcgttctgcctcgcgtcatttctcaagccgatctatatgcctgacggcgtatgcgactactttcttatgtggatctgcgttggattaccgttcggcatccggaggatgtgcctctggctcgttcccagcggctacggtatctccggctcagtcggcatcttcgcattgaacttaatcataggcggtcttatcggaggacttgccttcttcatcgggctgctgctcggtgtcattcataccatccgagaaataatctgaactacatcgtaaacgaagagggtttgtttcttctccaatttggagtaagaagcaaaccctctttttttgttgcccaaaagccggaatatttgctggcgatgcggcgaaggaaaggagtttttaagtatgaaacgcatgacagccggtgatctgcaagcactggaattgctgatgcagaccacacccggctttgagcattttgacagcggcgcggatggcattctccctgagtgccgaagctgccgctttcaccgtcctcactggaaatatcaatcctgcgtgtttgcagagtgtccttactgctgcaatcccgtttcaaccctcaaaaatcaaagtggcacatctgctgccggaaaggaagtcagtcatggataacaaaatcgaagtcttcaagaatgaacagttcggtgaggtgcgaacgatcctcgaaggggaaacactcctgttctgcggttcagatattgcgaaagcacttggatatgcccgacccggaaaggcaattattgatcactgcaagggtgtcctaaaacgggacacccttacaagcggtggtatgcagtccctttcctatataccggagggcgatgtttaccgactgattgttcacagcaaactccctgctgctgagaagtttgaacactggctgttcgatgaagttgtccccaccatccgcaagacaggcggctacatgacggactcccttctggaacgtattcagaaggaaccggcggtcattgtggagtttgctcaggcgttgattctggaaaagaatcgtgtgaaggctcttgagtgtgagctgaacacagcgaagcctaaagctgattactacgacgccttcatcaatccggatgactgcaccaatatccgaacgacggcgaaggaactgaaaatcccggagcgcaagttcgtccagtttcttctcagggagaagtacctgttccgctctccctccgggcagcttcttccctacaacaaggacagcaatgccggactgttcatcgtccgcgatttcgtgacgtactgctacaccggttctcagacctacttcacgccgaagggcaaggaggtcatccgagtgaagttccagaaaaagtgcgccgaagagctgcttcccaagatggcaaggtgatttctgtggcagtctatcgcgtaaacaagaatcgcggctatacggtcatggcgaactttcacctccgcgacaagagcctgtcactcaaggcagtcgggcttctctcaaagatgctctcattcaatgacggctggaagttctccaccaagggactttccgcaatctgcaaggaaggtccggatgccattctctccgcgcttcgtgagcttgaaaaacacggctacctcgtcaggcaccggcagagagacggtaaaggcaggatgagcagtacaatctttgagatatacgaagagccgcaggagtccacgccagaacaggaaatgccacacacggaaaatccatgtgtggagaagccagatgtggataatccacgcggggataagtccgcacaaataaatactaatcaagtaattacccaagaaagaaatactctctcaaagaactatcaatccatcaatcttgatgggatggacaggatggatgagcgaagcgagtatgaagagattatcaaagagaatcttgattacgacattctctgtcaggatccgaagttcgataaagaccgcttccgggagatcatggacatcatgctggatgctgtctgctctaccgctccgaccatccgtatcaacggcgaggatatgccgcagcaagtggtcaagtcccgctttctcaaactgaatagcagccacattgagtacgttctggaagcaatgaacaagaatccgtcagacatccgcaatatccgggcgtacctgttgaccgctctgtataacgcctctctgacgatagacaattattactctgcgcttgtcaaccatgatttctacgggcaggacagatcagcagagtcaaagaagcccaagacctacgattatagcctttgtgaagatactttttattgaataccatcgtgagcattgctcggaaaggaggacattgcaaatgaaaatcatctatcgccggattgtgccgccttagctgatgcagcattcccacaatcattccaaggaaaggaggtatcactgcaatgcaggatgaagtcaacaccaaagttgttgcaatcatgatcaagggcggcaaaatctctgccgaggtactgaaaaaggcgctggacaagttcgttcaggaaattgagaaggcacagaagcagatgcagcagcccaaagcctatcgcggcaagcagtccatcaagcatctgatgagccagaacgccgccatctccaacatcgaagtgacggacggcaacatcaagtcctttgagcggactgccagcaaatacggtctggactttgcgctcaagaaggacgtttccgttgagccgcccagctatcttgtcttcttcaagggacgggacgttgatgttatgaccgccgcgttcaaggagttctccgccaaaaccgtcaagcagaaggaacagccgtccatccggcacaagctggatcaggagaaagctcagagcaaggcgcagcacaaggagaaggtcaaggtcaaaaccaaggatcggggtgtggagctgtgaacaaacccgatgtgaagaagctcgttcttctgaaccttccgtatatcttcgccttctactttgcagataagatcgccgccgtgttccgtctcgcacccggcacagagttcatcgacaagctgacaaacggttttgccgtgttcggcacagccttcgcaaatccgctgcccagctttcagcccgtcgatctgctcatcggtctgattgccggtgcgctgctcaagttggcggtctacgtcaaaggcaagaatcgcaagaagttacggcagggcgaagaatacggatctgcccgctggggaaacgaaaaggacatcaagccgtacatggacccggagttctccaacaacgtcattctgacgcagacggagttcctgaccatgaacagccgcccgaagcagccgaaatacgcccgcaacaaaaatatccttgtcatcggcggttccggctcaggtaagacacgctttttcgtgaagccgaacctgatgcagatgcacagtagctatgttgtgactgacccgaagggtacggtactggtggagtgcggcaagatgctcgaaaagggcggctatgtcatcaagtcgctgaacaccatcaatttccggaaatccatgcactacaacccttttagctacatccgcagcgagaaggacatcctcaagctggtcaatacgatcatcgtcaacacgaagggagacggcgataagtccggcgaagatttttgggtaaaggcggaaaagctctactacacagctctcatcggctacatctggtacgaggcacccgaccacgagaaaaactttactaccctgctcgaaatgatcaatgcctcagaagccagagaggacgatgagaccttcaagaaccccgtggatgtcatgttcgatgagctggaagcccgcgatcctgaccactttgcggtcaagcaataccgcaaatacaagctggcggctggcaaaaccgcgaagtcgatcctgatttcctgcggtgcaaggcttgcgcccttcgacatcgcagagctgcgggaactgatgagctacgatgagatggagctggacaccatcggagaccggaagacggcgctgttcgtcatcatttccgataccgatgacaccttcaatttcgtcgtggcaatcatgtattcccagctcttcaaccttttgtgcgataaagcagatgacgtttacaacggtcggcttcccgttcatgtgcgctgtctgctcgatgagtttgcgaacatcggtcaaatcccgaagtttgataagctcatcgccaccatccgaagccgggaaatctcggcgtcaatcatcttgcagtcccagtctcagctcaagaccatctacaaggacgcggcggacaccatcacgggcaactgcgactgcacactttttcttggtggcaaggagaaatcgaccctcaaggaaatcagcgaggtgctgggcaaggagacaatcgacctttacaacacctcagaaacccgttccagcaacaactcctacggcttgaattaccagaaaaccggcaaggaactgatgtctcaggatgagatcgccgtcatggacggagccaagtgtattttgcagcttcgaggcgtgagaccttttctcagtaacaaatacgacattacgaagcatccaaagtaccggcagctctccgactacgacaagcggaacgcctttgacatcgaggagtatcggcagcacaagctggtagtcaagcccgatgacacattcgacctctatgatatgggcgaggtcgaagcggattaaagccccgtcgctgcactgcgcagtgggtaaagcctgatggctcccaaagcagaacagcgccggggcttctttttttatgcccattttcaaaaatacacaaccaatctttttcaaatcaaggaggaaaatctatggctttcatcaatcaggctgtcacggttcttcagacgctcgttatcgccctcggtgccggtctcgcggtgtggggtgttatcaacctcatggaaggctacggcaacgacaatccggcggctaaatctcagggcattaagcagctcatggctggcggcggtgtggtgctgatcggcacgaccctcatccccctgctctccggtttgttcggctaatccacggcaagcccagcttaaccgaagggtggtgaaatattgggcagcattttagaaaagatcgaacaggctctcaaggatatgctgatcggatggatcgagagcaacctgaccaatatgttcaccgatgtcaacgagaaggtgggaacgattgccgccgaggtcgggcaaacaccgtccggctggaacggcggcgtgtaccagatgatccggggactatccgaaaacgtgatagtccccatcgctggtattatcatcacctttgttttgtgctatgagctgatttccatgatcaccgagaaaaacaaccttcacgacatggacacttggatgttcttcaagtggtttttcaaggcggctgtggcgatctatctcgtgacacacacgtttgacatcgtgatggcagtattcgacatcgggcagaacgtggtttccggtgcagccggtgtcattcacggcaacaccagtattgatattgattcgacgattgcgcagatgcgtaccggcatggagaacatgggcgtcggagaactgctcggactgtcgatagaaactcttctgatcagcttgtgcctcaaaatcatggcgatcctcattacggtcattctctacgggcgcatgattgagatttactgcaccgtgagcattgcgcctattcccatcgcgaccatgagcaaccgcgaatggggcagcatcggcacgaactatctgaaaggcttgttcgctctggcatttcagggctttctcatcatggtctgcgtcggcatctatgcagtgctgatcaacggcatgatcatcgcagacaacattcattcggctctgttctctgtggcagcgtacacggtcattttgtgcttctccctgttcaagaccggaagcctcgcaaaatccattttccatgcgcactaaggaggtcggcagcatgaagaagtacagcatcatctacgccgatcccccttgggcgtatcggacttactccaagaagggacagggacggtcggcagaaagccactacccaacaatgtgcattgaggacatcaaggcacttccggtcggtgagcttgctgcgaaggactgcgccctgttcctctggatcacgttcccgtgcctctgtgaagcactcgaagtgctgacggcatggggcttttcttataagaccgtggcttttgtatgggtgaagcaaaaccgcaggaacgacgatctcttcaccggcatggggtattggacaagggcgaacgccgaaatctgcatccttgccacaaaggggcacccgaagcgagttgacgccggtgtgcgtcaggtcatcctcagccacatcgaagagcattccaaaaagccggatgaagcgcgggaacgcattgttcggctcatgggagaccttccccgcgtagagctttttgcccgtcagtctcccgaaggctgggacgtttggggcaacgaggtcgaatgcacggcacatcttccaatggaggaaacaccatgctgcggctaagacctatctctcttcgagacgccaacgagtatgtccggaagcatcaccggcatcacaagccggttgccggtcacaagttttccatcggctgtgaagcagacggtgagctggtcggtgtaatcatcgccgggcgtcccgtcagccggtatctggatgacggcttcacattggaggttacaaggctatgcaccaacggggcgaagaacgcttgcagctttctctacggcgcggcggcaagagctgctgcggctatgggctataagcgcatcatcacctacacgctggaaagcgaaaacggtgcaagccttcgggcttccggctggatctgtcaaggcaaagcgggtgggcttcgctggacgggcaagcgtcagccgaaggaggatcaatatcccgcacaaatgaagctgcgctacgaaaggcagcttagaaaggaggaaacagtcaatggcatttgttccggtcccgaaggatcttaaccgcgtcaaaacgaaggtcatgttcaacctgaccaagcggcagctcatttgtttttccgtcgctgcggcagtcggcgtcccgatcttctttctggcgaaggcacatctcgacttgtctacggcggcaatgctgatggtggtcatcatgctcccgttcatcttcttcgcgctttacgagaaggacggtcagcccgccgaaaagtatctgtaccacatcgtacagtccatgtttatccgggacaaggtgcgtccctatcgcacaaacaatctctacgctgaaattcagcagaaaatcaaagaacaggaggaattgcagcttgaacaacagcacagcaaaggcaaagcctaagatgacggtcaaaaacggcgtcatttacggcgatgccctttccgctcaggaaaagaagcggattgtcatgcagaagaaaaaggataggaaggcaaagaaagtccgcaagtccgcccagcagaccattccctatgtggaaatgtgccgcgacggtatctgcaaggtgaacagccgcctctacacgaagtccatcgcctttgaggacatcaactaccagcttgcgcagaacgaggacaaaactgccatcttcgagaactggtgcgatttcctgaactactttgacagctcgatctttgtccagctctccttcatcaatcagaaggcaagtctcaatgagtttcgcaagcgcatcaacattccggcacaggaggacgccttcaacgacatccgctccgagtattccggtatgctgcaaagtcagctcaccaagggcaacaacggactggtcaagaagaagtacatcaccttcggcattgaggcggactccctccgcacggcaaagccgaagctcgaacgcattgaaaccgacattctcaataacttcaaaaccctcggtgtgagaaccgagccgctgtccggctacgagcggctgaaagtgcttcatgacgtattcaacatggacaccaatgagccgttccgcttttcctttgacatggttgcccggacaggactcagcacgaaggatttcatcgcgcccacttcctttgacttccgtgaaggcaagtgcttcaagatgggcagaaccatcggtgcggtgagctttctccaaatcctcgcgccggaactcaatgaccgtatgcttgccgacttccttgagatggacagcaacatcacggtcaattttcatatccggacgattgaccaggcaaaggcaatcaagagcatcaagatgaagatcaccgacctcgacaagatgaagatcgaagagcagaaaaaggcggtccgctccggctacgatatggacatcatcccgtccgatcttgccaccttcggcggtgaggcaaagcgtctgttgcaggatctccagacccgcaatgagagactgttccttgtgaccatcctcatcatgaatacggcaaccaaccgccagaagctcgaaaacgcggtgttccagaccgccgccattgctcaaaagtataactgtgcgctcaagcgtcttgacttccagcaggaggaagggctgatgtcctctttgcctatcggcgtcaatcaggtggaaatcgaacgaggactgaccacttccagcacagcggttttcgtgccgttcaccacgcaggagctttttcagggcggcgaagctctctactacgggctgaatgcgctgtccaacaacatgatcatggtggaccgcaagcagctcaagaaccccaacgggctgatcttgggtacgcccggttccggtaagtccttctccgccaagcgtgaaatgacgaacgccttcctcatcacagaggatgacatcatcgtctgcgaccccgaagccgagtattttcccctcgtgcagaagctcggcggtcaggtcatccgcatctcgccggtcagcacggattacatcaatccgctggacatcaacacgaactactccgaagaggaaaacccgctgacgctgaaatccgacttcatcctctctatgtgtgagctgattgtcggcggcaaggacggcttgcagccggttgagaagaccatcattgaccgcagtgtccgcatggtctatcaggagtttcttgcagaccccaagccggagaaaatgccgatcctcgaagacctctacaacattctgagaaatcagaaggagccggaggcacagcgcattgcaactgcccttgaaatctatgttcacggctctctgaacgtcttcaatcacagaacgaatgtggatgtcaacaaccgctttgtctgctatgacatccgcgaacttggcaagcagctcaaaaaactcggtatgctgatcgtgcaggatcaggtgtggaacagagttaccatcaaccgcgcccagcacaaggcaacgcgctactacatggacgagttccaccttttgctgaaagaggaacagaccgccgcgtacagcgtggaaatctggaagcgtttcagaaaatggggcggcatcccgaccggaatcacgcagaacgtcaaggatcttcttgcctcccgcgaggtggagaacatttttgaaaactcggattttgtctaccttctgaatcaggcgtccggcgaccggcagattctctcgaaggcgctgaacatctcgcccagccagcagaactacatcaccaattccaatgccggtgaggggctgatcttctacggctcgaccatcgttcccttcaaggacgatttcccgaaggacacccagctctaccgtatcatgaccacccgtttagaagaaaccgtacagaactaaggaggatttttgaatatgaacaacaagatgattaccattccctacgcggacgctatcgaatacggagagaacacctccgcgctgtttaaggctctgtgggagctgaccgatctgatccgactggaaagcgacctcaagaagcatcaccgcgcctatctccatgtgagggaggacatcgacgaaaaggtcaaggaagcgcgtcagattatgaccaaagtagccgtggatatgatcggcttttacttcaatgttgatgtttctgagtgcagcaacaacgatgagaatacccccttcgctgacgcggcggatgatgaaaccgtttctatccccaagggcgagtatgagctgatgatcgacgatctgctcacgatgtccgaaatcattcagagcgtcgcagatatgcgcacgcaggatgtgaaggcaatccgcgagttcggcaagttcgtccccgcctttgccgcctttgagaagaaccgcctgagcctctaccgcgacgcggcgaaggaagcagaggaaatcttcgaccgttgggcggacgagattgacgatctcgacgaggacttcatggaagacgaggactacgagccggacgagtattactccgattgatgcccattgaaatgttatcgggttttacagccaacatttcaacggaaacgcaaatccaacagaacaggaggtacaccaccatacaacttgacatcattcataccggcgattgccttaaaatcctgaaaactctgcccgatgacaccgttcattgctgtgtgacgtcccctccgtattacgcgctccgcgattacggcatggaggctcagatcggcagagagacaacgccgaaggaatatatctcgcgcctgacggaagtgtttaccgaagtcaggcgcgttttgcgtccggatggaacgctctggctgaacatctcggacacctacgctggaaagggcaatcagggagatttcattgacccgaagaacccctacggcagaaacggtcaggctgtggctctcaacaacaaggttgagggctgcaagccgaaggatatgatcggcattccgtggatgctggcttttgccctccgcgataccggctggtatctgcgcaacgacatcatctggatgaaggataaccccatgccggagagcgtgaaagaccgctgcgcccgctgttatgagcatattttcctgttctcaaagtccaagaagtatttcttttactacaaggcaatctccgagccgattgcctctgcaacggcagaacgtctcaagcgcggcatgaggggcggcaacaagtacggaaagcccgttcccggtcagcctcagccgcagtccatcaaccgcccccgcgagcatggtgagatcaaggacagtgacatcaatccgctccgcaacaagcgcgatgtctggaagatcaacaccgtccccttcaaaggcggtcactatgccgcctaccctccaaagctggttgaaacctgtcttctcgccggttgtccagaaggcggcattgtgcttgacccctttatgggaagcggcacaaccggcatggttgccgcgcagatggggcggcattttgtaggcgtagagctgaacccggaatacaccgagcttgcctacaagcggattggaggtgaaatctgatgtccaaggaaccggaactcaaagcccgtgacaaggtggtcgtgcggatgacgcgggaaggcgcggttgaggaaaacctgacggctggcaccgagcagcgtgtgtcaaagaggctggaagatgcggagctggtgaagcccggtgagacagtcgagccttccgaagctctttctgcggaggaacagaaaaaggtgcagatgcgccgtcagcagcgtcagtttcaggcggaacacgccgaggataacgacacacagccgccctcggaaacgtctgtcacagaagagaaaaggacagaaactctaccccagaatgtacccgaaccgctgccttcggaaacgccgttcaagcctcctgttttggagcagcacggtgtttcttctcataccggcacggtgattgccgaaacggttgtcacgcacaagctacgcaagacctctgcggttgaagccgttgacgcggatgccgttctctcccaagcggcagagacttcctccgcaaagccggtctcggacgatgccgtcccgcccacgaagcggattcagaagctcgaaaggaagtccgaaaaggcgcatgagcgtctggacgctgcccgccagaagctgcccacgcacaaggttctcaagaaagagcgtgtctttgatgaggaaaccggcaagggcaaaacccgccttcattttgaggatgagctgaaaaagccgaagggcaagggcaagctgcaattcgaggcagacaaaaccgtccgcaaggtcggtgacactctcgcctccggcattcacggcaaaatccatgaggtcgagcaggaaaactcggcggtcgagggggcgcacaaaacagagattgtcgcagagaccgccgcaaggcatttcagtcatcacagagaaaaaagcgtcaacaagccctatgagaaggtttctaagctggaacacaaggcggatgctgctgatgcgaagctccaatatgagagaaatcagcaggagcatcctgagatgaagaagcagaacatgaacaagcactatcagaagcagaacatcaagaaggaatatgccgccgctcgaaatgccggttctcagactgccgggactgccacaaagaataccggcaagaagctcggtgaaaaggtgtccgacaagatcaaggagttctttgagaagaacaagaaggtcttcatctggatcggcgtcggaattgcccttctcgtgttgctcggtgctggtatcagctcgtgttcgatgctcacctctaccggctcgtcggttatcgcttcctcttatctcagcgaggatgacgcgatgctgggtgcggaggcgcagtattgccggatggagcaggagctgcaacgctatctcgacacctacgaaagcactcacagctacgacgagtatcacttcgatctggacgatattgagcatgacccctatgtgctgatctccattctctcggctctccatgagggcgagttcacgctggatgaggtgcagggtacgctccaaatgctgtttgaaaagcagtatatcctcaccgaagaggtctttgttgaaaccagataccgcacggagaccgacacatggacggacgcagacggcaacacgcacacggaaacctatcgcgtcccgtatgactactacatctgcaacgtgaagctcgaaaacttcaatctctcccacgtcccggtctacatcatgtctcaggaacagctctccatgtacgcaacgtatatgtcggtgctgggcaaccgcgaggatctgttcggtgactctccctatgtggacaagtacatcaccaatcctcccgccgactacgatgtcaacccggaatacctgaacgacgagaagtttgcagcgctgattaccgaggcggaaaagtatctcggctatccgtatgtgtggggcggctccaatcccgacacgtccttcgactgctccggcttcgtcagctacgttctcacaaacagcggacttgtgaataccgggcggttgggcgcacaggggctttacaacatcagtacgccggtttcaaaggcaaatgcacagcccggtgatcttatctttttcgtcgggacgtatgacacccccggtgtgtcccacgtcggaatctacgtcggtgatggcgtcatgattcactgtggcgatcccattcagtacacatccatcaactcttcctattggcagcagcatttctacgccttcggaagacccgcctattaaaagaaaggagttttgcatgaatcccaagtatcagaaagtcctctccgacattgagaaggctgaaaagaagaagtccgaaattgaaggacagctcaaggagctgtacgacaagaagacggagctggaaaaccttgaaatcatcaataccgtgcgctctatggtgatggacaaggatcagatcatggtgttcctgtcttccatgaagagcggcaccaagcccgctgaaaatacggaggtaatcgacaatgcgtaagaagtttcgttttctgaccatccttgcggtctgcgtcatggttctgtcctgcttctctgtcacggcgtttgcctacgccgatgataccgagcagaaccttcccgttacggaggcaactcagcccgaacagcagcccgcagtcactcccgcgccggaaaagccgaagggtgagccgattgacgatgagggtaacgcctacacccgcgacttgctctatgacaaggcaaccaacaagcagttcatcactgtccagacgaagaacggcaacaccttcttcattgtcatcgactacgatgcgcccatcaacgaggatgaggaacagtatcagacgtacttcctcaacatggtcgatgagagcgatctgcttgcactgctggatgaagatactgcggctgcgctgaccacctgtaactgcaaagagaaatgcgctgccggtcaggtcaacaccgactgcccggtctgcaagaccaacatgagcgaatgcgccggcacagcccccgttacacctgagccggacaaggatgcagaaaccgacgttcctgctcccaagcccgaaaagaaatccaatgtcggtatggttcttatcgtcttcgtccttgttggagctgcgggcgcggcgtattactacatcaagttcgtcaagggcagaaagcccaaggacgaggatctggacttcttcgacgatgaaggctacgaggaagagccgtacatcaacgaggatgaagagccgcaaattgtggtagacgaggaaacggacggtgatgaggattgatcttagtcattgctgaaaagcccagcgttgcccagtccatcgcaaaggttctgggcgcaacgtcccgaaaggacggctatatggagggcggcaattacatcgtttcgtggtgcttcggtcatctggtggagctggcagacgccagctcctacgatgagcggtatgccaagtggcggtatgacgatctgcccattgttccggaaagctggatgtttgaggtcacgaaggacaaagcacagcagttcaaggtgctgtccgctctcatgaaggacaagcgcgtcgccgagctggtctgcgcaaccgatgcaggacgcgagggtgagctgatcttccggctggtctacaacaaagccggatgcaccaagcccttcaagcgtctgtggatcagctcattggaggactccgccatccgcgaaggcttcaaccatctccgggacggcaaggaatatgaccgcctctatgaagcggcactcagccgctcgaaggcggactggattgtcggcatcaacggcacccgcctgttcaccacgctttatcacaagaaactggtggtcgggcgcgtccagacgccgacccttgcaatgctggtggagcgcgacgggaaaatctccacgttccaaaaggagaagtatttcaacgtccatgtcggcaagggcgatctgaccgccgatctggaaaaggtcaaaaccgaagaggaagcaaagaagattgcggcggcttgcgagaaaaagcaagccgtcgtttcttctctcaagcaggaaacgaagaccgtcaatcctccgaagctctatgatctgaccaccttgcagcgcgaggcaaaccgatactacggttttaccgcccagcagacgctcgatctcgttcagacgctctatgaaaagaagctcctgacctatccgcgcacggacagtcagtttatcacggacgatatggaagacaccgcccgtcaggtcatttctattgtctgccgccagcttccgcttttctccggcgtttcggtcactccggacattgcccgcgtaaccgacaacagcaaggtcacagatcaccatgccattctcccgaccgtccagcttgaaaagcaggatgtttcggcgcttcctcagtcggagcagaaaatcctcaatcttatcgggatgcgccttctgtgtgcgaccggcgagaagcacacctacgcagaaacgcagatctcgctctcctgcgagggctacgagttcaaagccaagggcaagaccgtcgttcaaaacggatggaaagccattgaagagctgtttaaggcatctctcaagacgaaggaaaaggacgatcccatgaagtccctgcccgaagtccatgagggcgatgttctggataatgtgtccgccagcgttacggaacacttcacgacgcctccgaagcagtacacggaagacacgctcctgtctgcaatggagactgccggaaacgatcagttcgacgatgacaccgagaagaaaggactcggcacacctgcaacccgcgccggtatcattgaaaagctggtgaaatccggctttgcagagcgcaaaggcaaatccctcattcccacgaaggacggctgcaaccttgtctgtgttctgccggaacagatcacatctcccgcaatgacggcggaatgggaaaacacgctcatggagattgaacgcggcaaggcagatgcggacgccttcctcagcggcattgtccggatgaccggggatctcgtgaaagcctatcccttcctctccgatgccgaagcccagcgtttcggcacgggtaaggaggaaatcggcaaatgtccccgctgcggctctccggtctacgtcggcaagggcaatttctactgctcgaacaaggaatgctccttctgcctgtgggaagacaacaagttcttttccagcaagaaaaagaagctgaccaagaagattgcaaaggagctgctggacaagggctggtgccgcgtgaccgggctttacacgccgaagaagcctcagctctacgatgcggtgatccggctggatgacagcggcggcaaatacgtcagcttcaagatggagtttgatcgatgacccgcccaaagtatgttgcttcatgcagcggaggcaaagacagcgtagcgacgctcctgctggctgcacagcacaatgagccgcttgacgaggcggttttcagtgaggtcatgttcgacaaagacacaagcggcgaagtcccggaacaccgggacttcatttatgaccggctcaagcccttctgcgaaaaggagctgggcatcaagtttaccattctccacgcggacaagacctacgatgaggtgttccatcatgtcatcacccgcggaccgcacaagggcgaggttcgcggctttgcatgggctggtatgtgtgcagtcaatcgtgactgcaaaatcccgccagtccgcaagtacaatgccgcactctcaccggacactgtgagctatgtcggcatcgcggaggatgaaccaaaacgacttgcgcgtctggacggtgtgaagaatgtcagtctgcttgccaagcatggcatgactgaggttgacgcctacaagctctgtcaggaacacgggctgctctctccaatctacgctcactgccggaggaacggctgctggttctgtcccaacgccagtgactcggagctgctgcacatggtcacaaattatccggagatgtttgaccggctgattgaatgggagaaggaagacaacatattccatcgtcgaatgacacgcagagaaaccccgtctgaggtaaaggctcgtttactgagcaaatcccagacggggttttcttcgcccaaaagcaaataagaaatggaggtttgagatggctgaaaacaaaaatgcacagcaagtccgcgaaatcacggacaagctggaacagggcatcaaggagctttttgaatccgagcggttcaaggaatatctccgcacgatgtccaagttctacaactattccttcaacaacacgctgctcattgcgatgcagaagccggaggcaacctatgttgccggttatacctcgtggcagcgcaactttgaccgtcaggtcatgaagggcgaaaagggcatcaagattcttgcacccgcgccgtacaaggcgcaggaagagcatgagaagattgatcctttgacgcagaagccggtgatcggcgcagatgggaaggctgtcacggaaacggttgaggttctgcgtccagcctttaaggtggtgagtgtctttgatgtttcccagacggacggcaaggagcttccggacatcatcgtcgatgagctgaaaggcaccgtcgaaaactacgaggcattcttcgatgcgctcaagcaggaatctcccgtccctatttcctttgaggacattccgggcggtgcaaagggattcttctcgccggttgaaagccgcattgccattcaggagggcatgagcgaaatccagacggtcaaaaccgccattcacgagatcgcccacgcaaagctccacgccgtcaagccggatgaaaaagccgcgccagaagataagaaggatcggcacaccaaggaggttgaagcggagagcgttgcctacaccgtctgccagcgttacggcattgaaacctcggactattccttcggctacattgccggttggtcatccggcaaggaaaccaaggaactgaaaagctctctggacaccatccgcaagacggcggctgagatgatcgagggcattgacgccaagctcaaggtgctgctggcagagaaagcacagtccgtcgagcaggaagctgttccggagaaaaaaccggaagcccccatttaccgcgagacggcgaattacgcctatgaagccggtgagctggagtcatatcgtgcttctctcgccgcaaacgtggaatgccgcaaagcgattgaagcggcgatcagctccaactacggagataaccggctggatgcggatgctgccgtgaagagcgtccttgagcagttctctccggagcgcgtccggtatgtcctcgcaaacaccattcagcagaaagactttgacggacgtattccgcagcccctcaaggaatgggcgaagagcgttgatgtctgccccgaaaacgcctcccgcttccttgtggataaacccaatcccggactgaccgcccttttcgtggatgcgttccgtcagcagaccgaaccccagaaggaagtcatgcctgaaaaaacagaggaaagtgacccggaggttgttgcatgggagaatgatgagattacctctattgaggtaaaaaccgtggaggtcaagtctccctttgcccccttgccggaggaagcagcaaaagcaccgaagacacaccgcctgactgccgaagaaaaggagatcaaagccgccgtcatggacacgctcaaggggcagatcgcctataacaacgacggtatgcgggcgtcctatcgcgcctctaaccattccttcaatctgctggcacggaacggcgtcaggatcgagggcaacacggttacgcagaatggtgagccgctgttcaaaatccatcgccgtcatgcgacgcggaaaacacagggctgctatcgtgagctgatgccgacgctggaatacgtcaagcaggagcagaagcaggaaaagccctctatccgcgatcagctcaaagctgccgcgaaaacgcagccggagaagaagtccccggtcaaatccaaaacacgcgacatggagttgtgagaaaggagaagcatgaagaaatacacagacgttgacatcgttgcggagctgcagaggctcgtggacagtcatgtagacagctacaaggaagacttcgacatcgacaagcgcatcatccgccgcgctgccgaaagccggaatcccgaagagaaaacgctgatgtggttctgccgtccgcatggaacgcactgcctcaatgaaaatcaagtctttattcagggaacgcgagatcacaacaccttccgtttttacgcggaacagacctacgacgagtgcattgctcgtgtcattgtcccgaaagccgttaagcgcggcaaggtcttcggagatgtctttgagatcaactaccgggaacaggcggcaaatgtggcgcagaactcggttgcgccggatcacgaccggctgacctttgcagacggctttgtgctggaagccccctgccgcagcagcttcgatgcagcaatggctctgatcggtgagcatggcggcgtcaagacccaccagacgctcccgaaggacgcggatgctctggtggaagtgctgtctaagcagaaaagccgccgtgtcagactgccggaggcagataggacagaggtgctttcgccgctccccgtcgcagaactccgcaaatatgaggcagtcaaaaaggctcatccggatgcgctggtctgctttgctcagaacggctattttgagctgtacggcaaggacgcaaagaaagccgcgccgcttctcggcacaaaactccttgaaaagaaggtgcgcggcaagccttccgtgccggttactggtttccgtgaaagcgcatgggtagccggttctcataagctctggaagtccggcgtggatgtctttctcagcaaggacggcgagaccttcaaggaactcaaagccgcagattacattcctgtcggcgcgacgctgaatgtggatggcatcaagtgcagaatcgaagcggttgattttgccgctgatgaagtccggctgacgaacatcgaggacaagaaccgccccatccgcttttcggaaagcatccagtatgtccgctcctatgtggaagatgccggaacagccatctacgacaccatcccgaagaagcccactgcccgtgaatccatccgcgacaagctgaaatccgcgcagaaaggacagccgccccacacgccgaaaccgcagaaatcaaaaggaaaggatatggaactctgatatgaaaaactttaccgtggaagaaatcaacctgatgtgctgcttcaacacgtccagccggaagcggctgattgacgatatgaagagcgtcactctgaacgacgtggacggtgagatcgcggagctgatgtacaaaaccgtccggaagctcgaatccatgagcgacgcggagtttgaggaactgtatatcatgccggacggcatggtagatgactgaaaggaggatgcctatgcccgtattagacggtgattttgaagccttcgtcacaaaccttggcaagtacaacgagggtatgctggtcggtgagtgggtaaagctgcccaccaccgaagaagagatgcagaaggtctttgagcgcatcgggatcggcaagcaggatgagttcggtcagccctatgaagagtggtttatcaccgactacgaatgtccgatctacggtgttcagaagatgcttggcgagtacgagagccttgataagctcaactaccttgccgctttgattgacgagctttccctgagcgatcaggaaaagctcgttgccattatggaggctggctgcgatgaggtcagcgacatcgacgatctcatcaacctgacgttcaatctggactgctacgacatcatgcccggtatcaacgacgaatccgacctcggctattattgcgcccacgaagccggtatctactctgaaaaggatctcggtcctctggcaaattacatcgactatgaacgctatgggcgcgacattgcgatggatgagcagggacgcttcaccgacgagggctatgtccgtgttgcaagcgaacgctgggacaggcagtttgacggtgagcttgatgatattcccgacgaataccggattaccggctcaggagaagccgccgagcatgacagcaccatcgctgttcttatcgtcgagccgggaaaggagccttatgtgaaggagattgactccggtctggagtccttgcagcatgaggtcggcggctgcatcgaggcgatttacccctacgaagacccggttgccttagtctgtaatgaggaaggcaagctggaaggtctgcccctgaaccgcgctctgcgtgatgaggacggtgacatctatgacgttgttgccggaacattcatggtagtcggcttgacggatgacagcttcggttctctgaccgtagagcagatgcagaagttctctgacctcttcaaagtgccggaacagtttgttaagttgggcgataagattgttgcgatccccatgatctcgaaggagcagcagaagcaggaagctaccgagcagaaggactttgagatgaatgccgacacctccggtctgacggttgccggtcacatcgggacatggcacaccattgaccggcatgaagtcggcggtcacggcttttaccttatggagcatgacacctacggcgatgaggctgcctgcatcattgtcgatgagcgcggcaagctcgtccttgatgatgtctacaacggcttcgacgatgacacgctccgccttctcgaccttgaggtcaaggaagtgccggaaatgcccgatcctgcgctctccgttcaggatatgaaggactacggctacgcatgggctggcgtcctgcccgccggtcaggacgcggctgaaaaggcgatgaagaagggctgcgaggtttaccgtctctattcggataacaccgagggcttgtgcgtggatgcaaaggagattgccgaccatgcggcaaagggcggaatgctcggtatcagcaaggaaagctggatggcggctcttgagaaggaaaactatctcaaggcagcggagatgtcgatggaggatgactacggcatgattgacgggatcatcaacaacggtccgaaggaggacaagacccttgatgccaaagtccccgaaaggggcgagaagtcctccatcatggacaggctcaagtctgcaaaggctgaaaagcagaaggaatgctgccctcccaaaaagcacaaaggagagattgagttgtgagcagaagtcagaaatggaggcaggagtggtcgttcttcatcggggacagcggacgccggaagtataaccgcttttgcgtccgctgcgtccatagctgcaagcagagtttccgtgcggatctcatcgcctgtccgcacttctcccgcaaggcatcgaggtgtagacagttaggggtcgaaaaagcctgtgattgcaagcctcagagcgacgcaaattgaccagcctaagtgattgtattccctgcgcagtttcttctttagcgcggaaataagtgtcgatttcggcacttgtttgaatgcccggaaaacgaaccaagagcctctgtcgatgcccgttttgggtgtcggcagaggctctttttttatgacatattcaaaatagcggacagcaactcttgaacctgttgccggtattccggctttatatccgaaatacgtctggcaagcgcaagggcttccgtttctggctcgtcggtcccaaagataattcggtccgcactgacgcccagcaaacggcaaagacgctgcaaggcttcaagagaaataccggaagcaccacgctcaatagcgctcaggtgattcggcgtcatgccaagcatttctgagagcgtgtcctgcgtatagcccgcctgttctcttgccacttgaatattgccgccgatttcaatattgatgtccttcttctctcgcatagcctcaccacctttgcatttagtgtacctaacggcggtgtcattatccacggtacgccgtcgttgattttgctaacgacaatgcgttgactgtccgtgatgagggtgatagaatggagttacctaccaaaagagtgaaagaaggggtgtcatgtcacgcattattgagtttagaaagtctgctcaaaaagctgcaaagcaatccgttcaaggcaagacttgtgcgtttaccggtcatagaccgcagagtcttccgttcggctttgatgaatccgataagcgttgtacttctttgaaatctgttatgcgggatcagattgtagcactcatcgagaacgagggcgtcacgcattttattaccggcatggctcttggcgtcgatatgtacgctgctgaaattgtactcgatttgaaatcaaaataccctcacattactctggaaagtgcaatcccttgtgagacacaagcgatcaaatggtctgtggcttcacgggaacggtattataatatcgcggcaaagtgtgacaaggagaccatgctgcaacgggagtacacgacggactgcatggacaagagaaatcggtacatggtcgatcacgccgattatattctcgcagtatggaatggatgccccagcggtaccgggaacaccgtgagatatgcccacaaaaagggcaaatctatcatcgttatcaatccggtttcccttgatgtcacgcgggaataaggcaaaaatcccactcctgaatcaagagttgtgaaaaccgtgaagtatttcccgatagtgaatacacattgcactactcggtgattattggaaacgtgtacggcgtatgctgcccagtgaacatctccacggaacacatcgaattttcacggcttcgtaaaacggaaagtgtcaccttatgaacagtcccttgccgagagaaaaataaatcgctggaaacgggaacgcccccggcactgtgcgtctggcacagtgtcgggggcgtttttccgtgtcttagttatgagccagttcatttaggagcagctttcgatagtccacatccaagacgcagcgatggaagtccatcagacggtgttcgtcgaacagcttttcacaaagcttggtcagcggatgattcatcagctttgcagaaatgccagtctcgttgaaaaaccttgcccatgtgaagacctcttctaaatcctcctgcccaagcgtggcaggaatgatggcgttgcagagacggacaatggggctgtccgtaaatcgctctgcgacttcctccggtgtgcattcatagcggtcacagtcaaaggaaagcgcatcctcaatttttagataattttcgatttcatcccgcgtcaaggttatggtgtagtctcccataccggacggcacatcaatattctccatgacatcaagttcgtaacgggatccgccgatgatcgcttcaaaggagaaggactgacagattactgctgggtttttgtctatcttgtcctcattcagaaaggacagcggattatactccgtcagttcccagtcgatttttcctctctctgtttgctcggcaatctgctggatcagatgttgttcttcttcgtgcagattttcattgtacaacatgatacacctccgttttctgattgtcgtttttttggggggggctgctctatgtttccgaagagactgccgtttgtatcatcattccttggctgagggcagaccttcgtaaaacttcctcagttcgtccaaactgcttgtccgatttttgataggcagtgagtcccatgtaatgtcatgatagcgttccggcggctcgtcccgcagtcttcggtcgataatgcagacaatgccggtgtctgtgaaattgcggatcaatcgcccgataccttgcttgagcttgataatcatttcgggaacgcggacatccatcagagcgtcctttgcgacggaacacttatactcgataattggatcggggacagggaacggaagccggaaaatgatcacattggaaaggctttttccttcaatgctgataccttcccaatatgcgcccgtccccagaagcacggagttcgtatcttccttaaactcattcagcaccttgtcctgcgacgatcccggctgttgcatcaggattttgtacggaagatttttctcactgagaatggagtagacctcttccatgtcggtcttcgccgtaaacagcacgagtgccttcccgttggaaatgttcaggatctcaagcagccgctccacgcccttttcaatgaaggcttcgtgttccttggtcggatgcgggagatcgtcgcagtagtagatcatggcgtgttcatcgtatggatatggggaaggcttcggttcggataagcagccgcgttcaccaaccggaaagccggtattgctgataaagtaggaatactgttcttccagagacccgctcgtggcgttcgtcagcgtggcagaggtcaagatggttctttcatcaccattgaagtataggcggctaacaatttcccttgtgtttttagggcaatagacaagctccgtgttactaccgcgctgctcaatccagatcaacatatcatctatccggtcaagaagctccgaaagggactcgctgaccgcatccagatcgtcagaggcagcaaaggaacggttgtttctgaaatccatgctggaataaatctgaatgctggacgaaaggttatgtatggcggcgttcatctcggtaagcagctcaaccgcactgccgttttggtcgaagaaaaagcggtcagcatagcgcatatcctgttctgcctcgttgatctgcttttggacttgcgctttcaggcagttatagaaggcgatgatcgcgctctctgcctctcgcttttcaccggacacactgctctggtcagaggaccgcagctcatagaatgcactcttgatcatcccaaagagcataccctgtccgaaacgttccgttgtagcactacgcaccttatcatctaagttgtgcgcttcatccacgacaagcagatcagcggcggcgttaatcagcccgtcctgaccgcgccggagcttcatgagatgctgggtgagaaagtcctgattgcacagaacaacgccctccgtatactttaatgctgcgcggaccttgtaatacttgcacttcttttcacaggagccacaattcttcatgctgaaccgctgcacgtttaccttgtcccagacgccttgcggcaaaacctccgggaaatccttgcgttcctcatacttttgcttgattccttctttaagcgcgtccggtgggtctgctttcggatcacacatatattcatctgcgcgtttgttgcagagataatgggtctgtccttttgcgaggatgacatctctgttcagcccaagaaggggcattactgcgtggacatcacgccagagctgttcttgaagcgcgatggtcgaggttgcaatgataaccggcttgttcatgcgtttgctgtacagcagcaccggcacaagatagccaaaggacttgccaatgcccacgccagcttcaatcgcaaagtgctgatcgtttatgagggcgtccacaatctcaaaggacatatcctgctgcccttcacgcatttccaagccatgctgcggggcttcatcccaaaagaaggtgctgacttgctcactcatggagtacagctctgcttttctgcgctttttccgttcctccgatgtattgaatccaaaataaaatctattatccatccacattcctcccggaatagaaaccaaggctatctgcgtttcagctcaatgctgacgtttccgttctcgtcgatggtcagcgtcatgtgcctgatgtgcttctcatagaactgccgccgctctgcgggagacatttcgatcctcgtgtttcgcagagctgcatcaaacatatcgttgacattcaggtgaacggagttgtcaatccagcggtacatctccttgaacagtgcgtttttcttgatgtcctcgctgttgccggagtagaagtcatccagatagcagtagaatatcccagattctgcaagtgccgccttcatatccggtccgcatttttcccgctcaatcatgacaaggaatctggcgtccggtaaagaagagatcagcccccagtagtcggaatcgcttgagacgatgacgaaggaatccacttgcttctggtagtgttcctgacaggctcttgcggtgagcttgatgtctaccagtgatttgttctgcttgatccgctcaatcatgatatgttcaacggggatgcgggtgtagttttcaagaatccgccatgccgtagcggtatgtacgtcatcaaagagaatgatcgccgtaattttctgcatgacctcataatcaaggtttttgagcgtggcgcacagcttgtacgggtcagagttttcgcagtccactaccaatacggtcttctcactgtcatctatgaagtcgtagatattgttttttacaaaagcccctgcatcggagactttactgtattccgtgaaggcgtcgcaatgccattgataaagcagggtagcaaacttcttatcattatagaggacattgccctcgtccatcggtacccagttgatgtacatttgataggggtagtaggagagacttgcgtaatagatgtccgcagcatctttcgttccgtcctctgtcaaaccgtttggcataatgaacagctcttttatgtacgcccagttaatccagattggaaagaggcttttgcagttgttaatgcggtctgaaatcagccggttgatctcgataatgtggtggcagagctttgtactcgacttttttataaagctgattccatcattcgaaagctgctgcatactggaagccgggatgatctctggcattgaaagcagcccacggtattccatccgcatgatgtcatttattttccgataattgcgctcaatggcggtgcggatgatacagagattgcggataatgcgggcgttcttatcttgctcaagccggttgtatatctctatcttcggcggctcgtgttcattttggaaaatacgaagcgggacgccgatcaggtaggctacctttgacacaagctcataggtgctgtctttataagcaatctgctctccggcatattcgacgccattcaacatgactgaattgcccatgatctactcctttcgatggaacgtgggttattgagcgtactttttgaagttttcagcttgttccagaacctccttgtagacatcatcaatggttacgggggatagtcaaattcatccagtagcagtatgaggtcaacttgcagatttgccttaatgtcatcacgggtagaccagtcggtgtatttagctttgtcatcgacaataatcttaatccgctttgacaattcaatcatcttatcgtccgggtactcgaactcatacttcttggcaaccgccttgagaatgtcataaaaggctttttcctcgtagtcaattcccatgcccttgaaggagtctttttcctttttgagttcttcaaggagcttcgcaagctgctccgccacatcgtcaagaacttcattagcaaaagcctcatcacgacggcgattgttgtactcatcaacaacccgcttgaggcggtctgagaactccatgcccataatgcggttgacttttttatactcatcaatcgcttgagaaagaagcctctgcaacacctttatctttgtgtttggaagttggattgcattgatcttatccagatactcgtcactgaaaatatcaacagagatgtgcttccccgtctcaaacagttcctctataccatcagattgaattgcaccttcaagaagttcacggacacgggcattcatttgtgaaatgtcaggggcatcaccctttgtgagtttgaaaagaatagagcgcacagcacagtagaagtgcagatagtccttttctttatcagagatagcctcacttgaactgcataggttgaacgcttgtttcatgcgtttgactgccgccataaagcgagtttccaaatcttctgtgagctgtacatactcaacagcccgattgaggcaagcaagctgctctttcggtgagccgttgaagtaatccgtgctattgaagttgtggaacatctgagctaagacatcgagctggtctttaacaatcgtgatagactgctcgacgccttcaaactcatcgctctcaaagttggtgtatttcttgagggcgagattcatgtttttcttaatgccgatgtagtccacgatcaagcccttgtccttgccggtatagacgcggttgacgcgggaaatcgtctggataaggctgtgctgctggatgggcttgtcgatgtagattgtgtcgagtgccggtacgtcgaagccggtaagccacatatcaacaacgatggcaattttgaagtttgatttaacgttcttaaactgacggtcaaactccttgcgatcgtctttcgttcccagcatttcatatagttcaggctcatcatctttatttcgcgtcatgatgagcttgatcttctcgatgggtttgagttcctttttctctttttccgtcagttgaaccccgtcagggcaaacctttttctctgcccattccggtctcattccaactataatctgataaaaagcgtatgcaatcttgcgattagagcagacaaacattgcttttcctgcaacggtagctccttcggcaacgcgggtctcatagtggttaatgaagtcctccgcaactgcgtgaagtcggtcaggatcaccgatgatcgcatcaatatgagcaaccgccttctggctttcctcaatctgatgctcatttgcgccttcaacagcacagcggtcataataatcttcaatttcccgaacctttgcctgatcaagagtgacccgtgcagcgcgtccgtcgtagacaaggttgactgtgataccgtctttgaccgcctctgtcattgtgtaggcatcgacaaccggaccgaagacttcaatcgtgccatctacgggcgtgccggtgaaaccgacataggtagcattggggagagaatcgtgtaggtactttgcgaatccatagcttcgctctacaccttcggcagtgaccttgactttctgatcgaggtttatctgactacggtgtgcttcatcggatatgcagatcacattcgctctatccgtcagaagctccaagtcctcggtgaacttttggatggtggtcatgtacacccctccgcttgtcctgccttgaagttcctgacgcagcttttcgcgggaatcaatgctcacaacggtttcgtcaccaatgtacttcttggatgctacaaactgctttgagagctggtcatccaaatccgttcggtcggtaataatcaggattgtagggctatggaagaaggtactcttcataagcattcttgtgaggaagagcatagtatagctttttccgcagcctgtcgcgccgaagtatgtgccgcccttgccgtccccctccggtctgagatgtgccttgatattctcaaacagcttgaccgcagcaaaatactgaggatagcggcagacgattttgaggtctttgtccgagctatcagggaaatagacaaaatccttgatgactgccaaaagccgttctttgcggaacagtccgctcaccatagttacaagggaattgatgccgtccaattccttatcgtcagcttcaatctttctccacgcatagaagaagtcatacggggagaagaaggaaccgtatttattatttgcaccatcgcttatgacgatgaaggcgttatacttgaagagttcaggaatatcacggcgataacgcacggtaagctgagtataggcgtccatgatcgttgtgttttctttgactgcgctcttgaactcaagcacaacaacaggaatgccgttgatgaagacaatcccgtccggtatgcgtagctggttgttgatgccttcaatttcaaattgattgacgatcttgaacacgtttttctctggctcatcaaagtcaatcagctcaatgtaaatgtctttctttgtgtgatcctcacggttgaagatgaagccgtcacaaatcattttgcagactgctttgtttgcttcgtagatcgtaccggaaatagacctcaggcgaaggatgatgctatcaacttcgctgggggtaagtccatctgcggcgtatctgtccaggaggtacttccgcaaatcatcaataagcaggacctcagaacgttcacggtggatctgttctccattcagataaatataaccttcatcctgaaaaagctccatgatggacatttcaagagaatgctcattgaagttcgccattatcatttccccctaactgcctctgcatttctgcttcaaaggctttttcactttgctggaagtcgtactcctgatacttcaaacccagacgtgccagcatgagtgtaccttcccagtcatcaatgtttgagtattgcgttgcacggtttacgtctgtgagaacaccgaggatcagccctgtacaatcgagtgcaaagtctatcatttcctgtatgtccggatataaaacaggatgacgatccgttaggttctcgttgctcaatatacgctgtttatcgttgtgggcatagagcttattcctctgcattcggatgtcctctctttttttactcagcgcacagaaccgcttttggtacagggctaaaaactcaggaaaagtcaaatccacccgaaccggagcattctctgcatccggaatgttaaatatcgcaaagagtgtcctgtcagattcaacctgagccttgaaaaatcgctcttcttgtggcttgagctgatgctggtacgggatttgataggaaaacgctgttccatcatgctctacggtcattgtttctctgtattcaggaaataggtcttgattttccgcgcattttgcaaggagggttccaatggacacgacgccatttgagctatcatacagtttggcgatctccataaaacaggctttcatcaaagctccgtggatcgtttgatagaacgctggtgacatcttcatttcttccgcatattcgcgctggtttttgcgatactgctgcaatatgaggtaataggcatttgcgtcaaaagctccatgatgaagttcctcggcaattttgatcagcgtttccttgtccattttcattcctcccttcgtaggtaaatgataatttagaagcaactgcacaagcagtattccaagatcaattttcttcttactatgggtgtgacaagcttcccgaaggttatagcattgtcagtttggatagcctctgtacagtcaaaggtggcaaacgccttcctgccgactgtgaattacttgatgatccaacagaacacccttatattcgtgttcgtgatgttggcggaagtcgctatgtctgtctcacagaccaattccaatatattgatgaagaaacgcatcaagccatctcacgatatatagtaaacaccggagatattgtcatttcgattgttggtacaatcggattgctcggcaagattcattcctctcttgacaaagcaaaccttactgaaaactgcgttaaactcgcaggtattcatacggttacttccgactatctctattacacactttgctataaaaagcaaattaaggagattgaccttctgacagtcggtgcggttcaagcaaagttgcctatgtacaacatccaatctatgaaaatccttgtccctccgaccaaggtgatcagtgattttcagaagaaaatgaacgctttggacgagcaaattgaagcaaatacaatggaaatccagaaacttaatgagcttcgatccgttctccttgcaaaactgtccgattaagccgctaaattatcatttatccgccgctttagatcgatccgctccgtaatggtctggtacgccttcacaatgctgcgctgtttgtcaatagaggggacaggtagctctaccttgcacatttcatcccagtccattatttcccggacgctgccgtgagacttaaaacgtgcgtaacgatcaaactccggtctgctgaaccagagcattaggtattcgggtagtaactcgttttcatctttcacttcaaaaacggtatagatattgctgacaagcccctcatcataatccgtcagaagagcgataccaattttgtctccacgccgagaagtatctggaatgtaggtaaactgcccccgtttgactaccttgtatttcgtaaagtcggtaccaaccgtgtttgcaatggagggaatgaacatcttttggacggaaacacctaaaaggttttcctcttttccgtctgtgttcctgacatcgacttggcgaatgaaatttccaagcagcctatatctttctttcatcgtgacacctcaccctatgtattttctgtgtgccagcttgacattttgctgtttaaccatagcatagtgcatggtcgtgtcgatcttctgatgccctaagagctgctggacttgctctatgggcattcctttatctatggctgatgttgccaatgttcttcggaacttatgtgggtggacacgaggcagattcagcctttttcccaaatctcgaagccgtctttctacgccgccaatctgcaaacggtcatgcggtgcggtcagcgagacaaacaacgctgaacaggtgtctgtgcggctttccagatagttttggagatggatttttgtcctggcatcgaaataaacgatccgttccttacttccttttccgaaaacaacgcattcccgttcattgaagttgatgtcatcgcggttaagggcaaccatctcaccaacacgcattccagaggacgcaagaaggtctatcatcgcaagatcgcggacattgcagcagttgtcccgcatgatttccaatgcctcgtcggtataggtttccttgatcacctttgccgttttcaccttgtggatccggcgtaccgggctttttacgatgtaatcctcatcttcaagccacgaaaagtagctggataggatgcggcggatgttatctatcgtgaccttgcttgacttccggctcatctgatacactgttaggtacttccgcaagtcctcagttacaatctcttgaggctctttttcaatgccggacaacattgacacaattgtctgacggtaatagctcaaggttttttctgagcagccttcaatgcgttttgcgttgataaaacaggcaaccgtatcgacctttgcgctttcttccatgcccgcgctgtgacttagctctacgccactcagtaccccctcaaggacgccttgaagctgttttaactgtgcattgttcagatacggaagcatctgtcgctgcacttcttgaatcagttgttttttcattgtcgtgtctcctttgattattctcagagaacgacttttcagtggcagttcttagggtaaaactctcgccactggtgagagtaatggacggtaaatgataatttagcggcttaaccctgaaagcaaggtctgtgcgaaacctgtaagtttttctatctcaagattattgtcagcaacggcagcaagagttgcactcaccaacacagcccaattttgctgcaattcaatcggcggaatgggaatgtgtaatgctttgatataacttgtgggctttgcgattgatggaacgccggttgtgttatcatttgcgagtaattttctgcgcccggcatcagtgtgaaagtagaagagaacatactcaggtaatagcgcacgctggtcacaagtaagtaaaaactgactttgggaaatgacatacctgtcgaatttcgttttgtccggaacaagtgcaacttgccccagcgttccacgatgagtgatcacaatatcaccagagaaggctatcgaattttttagctggtttgctttttcttcctcgacatatcggaatgatcgttcagaaagcaagtagccagagatgttatctccgtttaacactggaacaccacgatcaacaaagcagtcagttttaatattagagccgaaaggtcccattgcaacgcgggacaatgattttcccaagggttgtgagaaccaatcactctgctcgtcacgatattcgggatgggtagcaaacgtccgcatgaactctgttttgcagagttccactaaattatcattttccgctctcttcaaagcaatgcggtcggtaattgcacggtaggacccaacgatctcacattgtctcgcataggaggaaacagggagctttatacggcaaagatcgtcccatgaaattccgcctcgaacactgccgtccgtcatgaaccagcattcacggtcaaactccggtctacgaagccacatcatcaaatactcttcatttaagacatcgcggtcaataatctcaaacatgaaatacgccggagaaactattgcggggctgtctttctcatagagtgcaatcggaagacgctcatcgcgcccaacgtgcattgggttacaggcaaacaatcccttgctgattagcttataccggctcaaatctgtgccaattacatttgcgacggaaggcataaactctttgtcgatgcttatgccaagaacagtgctggtgacttcctcggagttccgataatcaacaagctgaatatgtttaccaaggggttcataattcgatttcatagcccagctccttaaacacggtcaacaggtcagccttcgacttctcttctgcaacaagcagatcacgaagctcactttgcagcgtcttcattttcgtatcaaagtcgatgttctcatcacgatttacaaactcgatgtaacggctcggaacaagggtaaagcccttttctgcaacctcatcgaaggatgcgctgtaacaaaattcaggcacattctgataagtttcttcataaccttcctgctgccatgcgtggtagacgctcgtgaccttcgcacggtcttcttctgtcagttcaatgtacttcttttcataggggcttcccatttgccgcaagtccatgaaaaggatctcgcgctcacggttacggaagcgttttacctctccgttttcttcaaccacacgagcctttttattcttgtttagaatccaaagcgtaacgctgatgtcggtggtgtagaagaggttgcggggaaggatgatgattgcttcgacgagattgttctcgatgagctgacggcggattttcagctctgtgccatcgtcagacagtgcgccgtttgcaagcaggaaaccggcaacaccgttttgagagagctttgaaacaatattcagaatccagccatagtttgcattactcgtgggcggaacttcatagccgtcccagcgcggatcatcaatcagctcattatcaccacgccattctttctgattaaaaggcgggtttgccataatgtaatctgccttgaggtccttgtgctggtcattggtgaaagtgttcgctgccatttctccgaggtttgcagagatgccgcgaatagccagattcattttgcacagcttgtacgtcgtgtttgtatattcctgaccatagatagagaccttcttcttgttgccgtgatgtgcctccacgaacttcattgactgcacgaacataccgccagaaccgcagcaagggtcatagagaataccgtcatacggctcgatcatttccgcaatcaaattgacaatgcacttcggcgtatagaactcgcccttacctttgccttctgcaagtgcaaacttactcaggaagtattcgtagactcgtccgataatgtcattctctttatcgccggtgttgatcttatcaatctcgtccagcagtgatgccagctttgctgtgtcgatgtgaagacgtgagtagtagttgtccggcagtgcgcctttcagtgcgggattcgctttctcaatcgtatagagggcggtgtcgattttcagcgcaatgtcatcctgtttcgcattctccataatgaaagaccaacggctgatctcaggcaggaagaacacgttgtccttcgtgtagaaggcaacattgtcaacaaacttctcaccgtatttttcagaaatagctttcctttgtgcctcaaacttatcgctggcaaacttcaaaaagaagagactgagaacgacgtgtttgtattccgctggctcaacagaaccacggagtttatctgcggacttccacagagcttcctccatagaaatctccttcttcggtgccgatgcggctcgtgccatatcaaaatcctccctgtgtatttatctaacctattttacaaaaagagctgtacgaaaaaccggactcagttcttgtccgttcgcacagcctcacatatatctccgatgtcacagttcaagtaatcacaaatgcgcagcaaaatagagagggacacttcttcccccttattcagttttgtccatgttccggcagacagccctacttcatgtcgtagagaagccttctttatgtcgcgttccagaagaagcatccatagtttcttatagcttatgcgcacggcaaccatcctttcgcttgcttgcattcaacatcgcttataatattatactggatttcattctcaaaagcaattcgttgatgcagaaattaaagaaaaagtttcaatttctcgaaccttctctcaaggatgcagggcatctccggtcaacaggagatgccctgcttttgaaaggactattcgcgctgtgtgctgcgcagatgatcacggtcatggtcaacagaaggagcgagaaacgcatcaacattagacctgatcgtctctatttgctttacttcttttttgagcttcgcgcgttcatcatagagccgttgctgctcttcaagaagtcgctgctgttccgcttgcagtgtcttcaagctcggcagtttttcatcgccctgcatggcaagaagcgtactccgcgccgcctcaaagatcacaagctctgcctcatgctttgccttgaaccccggcttgtcttttgccttctggaaggcatcatatacaggcttgagccgctggtagttggagatatttttgatgagcggctggacttcccgcagacgtgcttcaacgcctttcagttccttgccggtacggtcataggaaccgtgaacatcctcaaccttcttctcaagatcggcgtattgaagcagattgttttccgtgagatagttgagtgtccgtgccgcttccttgaggatagtgagctttgctttatgctcgtaacccttgctgtcgataagcctgatccgctcctgaatatcttcgatgagagagatgcccttcggcgtggtctgtctttggcttcttcggggcgtccgtccggcaatccgctccttgatgcgttcctcggtgtagttctctccgatagttttagaccgggtaaaccgctcctgaccttcagcacggaaggagatgtatttgccagtcttgatttcatatccggcttcctgcatgagccgcagaaaatcatcgtagtccttcgccgtgatgacgagccggtcgatggtctgcttgagtttctgcttccagctcgtgccgcgtttggcttcggtgtactccttgtagcccatgcctttgttctgagagggaggaataacagagagaccgttttccttacagagccggtcgctgacctcgcgcatatcatagtaaatccgcttatagctcttatatgcgtggtagtccacgaagtcaaccgcattgaaaatcaggtggttatgaacatggtctttgtcaatgtgagtggtcagcacatactcatattttcctccgaggatttcatctgcaaactgcttgccgatctcgtgggcaagctccggtgtgacctctccgatttcaaaggactggatcacatgacgggctatgatcctgaccggattcatccctttttgctcggctatcttccgcgtccattcaaattcccgcgctgcggtctcgctggcacagccgtaggacgagaccagcagcttctcgtctgtcttttcgggattcagaatgtacgcgattgccttgctcaaagttcctcggattgctttgattttagtaactgccataccgcgtccatcttttctttcagctcgtcaatatcgtcctgatagaatcgtcccgtcgagttgatcctgcggcagacggtattgatgttcacaccgatcttgttgatttcggcggcgagctttttctgctccgtgtagtccacaacgatgatgtagccgtcgatcagcatcttccttgcatacgcaccgaagttctccgtgccgatcatttccatcttctttgcaatcgtccgttcttcctgtggtgtcagccaaatcttcttctgaatgtctcgtgttcttcgtaccatgctgcgccctccgtcgtaaagattagaagggtttgggactatcccaacaagcaaaaatctgatgttaagggcagggtctccttaactgatttttctccggtgggtactcaccggatttgcttgctaatctcccaaaatcgtattccccgaagattcctccgtgaaatgtcccttcactttacaacggacacaaaaagggcgtttgttgagtaccggatttcaaaaaagttaaaaaatcattggatttcccatgtgaaagccaatgtgtctgtcacatcaatatcaaccggctcaatctcaggtgcggcgcacttgctcatcgccatgagaggctgaatgcagtcttcaacatcgtagcttgttctggaaaaaacattgagttcgccccagttgtagtcgatgttgagcaactgcccaagcgtactgcctgatgctttgcaaagaatctccgcctttgccctggcgttctccgtcgcattgatcagcagctcttcgcagactcttgccgggtttttcacggtgaacgcaatgctgagttctggttgcgccccacaatccgcaatcgcagaaatgacctttgcaagctgcttgctgtcaaagtcaaaggcaagtttcaagcgatagctgcaagcatatccggcaaactctcgcttgtaatttccttgccgatccttgacattctcgtaccttgtctggacatcaaagctcgtggttttcaggtcttccttgcgatacccaacgcggactgcggcaccttgcagtctttcgattctctcggcagcttccgacattgcgcggtcataggtttcagataagacttcaatgttcagggataggatgatgtaatccggtcttgtggagacattgcctgtcccttttacggtgattgttctcattactttctcccgtcctttctggaattgaagtcctcatcaatacgttttttccaattcgtacccagcggtacgctgcatcggacagcggaaaccgctttgctcagaacttcatagttgagttgcgttccctcgcggtcagagtggtaattgaccgctcgatctgctccaattccaaaatgctttgccgtctcaactgcatcaatgtttgcaccgaggaaaagaaactcccagccgtacttttccttctgtcgctcaatcatcttcttgaccttctcgctgtcataacggcggcttgcattctccatgccatccgttgtgatgacgaacagtgtgtgttcagggacatcctcttttcttgcgtacttatggacattcccaatgtgatgaatcgctccgccgatagcatccagaagcgcggtgcagccgcgaacggaatagtccctgtcggtcatcggctccaccttctgaaccggcacacggtcatggataacctcgctcacgttgtcaaagagaacggtagagatcaatgcctcgccattctcttttttctgcttttcaatcatggagttgaatcctccgatggtgtctatttccagtccgctcatagagccgctgcgatcaaggatgaatacgatctccgtcaagttctttctcatgttttgtacctccgtatataaaaatatgactgcttggtgtctcaccttacagtcatattgtacttcggtattcacttcatttggtcgcatggcaagcgacattattctaaggacaagaacagctctccgtcaatgcttaggatgtcatccatcggaatcttcgtgccgtcctgcatggtaatcaggcgctcaaagtcatcaacctttatgactgcgccggttgcagttacatacgcaccgccagctttgcgctcatcaggtttgaagtaggttatttcaacctccggctcttcatcaagggcatccatgagaagctgatacctcatgttcaaagcggtcaaggctccctcatcaagctcaatcctttcgtcggtcagacgtccggtttccttgattgcagaatcatagccggtgagggcggcaaagggcgcaaactgcgctgcacgatctgacatcggcatttgtggtcgcgttttggaaacgtggtgaggaagtcccatgatctcgtcgtattttccgttcacgccttatgccctccaatctgcgcattgcggtctttcgcggttgcaccttcttcaagattcattgccttgaggatggcgttctttccatacttcttcttgatggcaagcgtggcggcttgtatcttccgctcacgctccaaagcggcatcttcggctttctgtttttcctcttcggcggcatagtcggtaaagaggtcgagctggactgcaccgtcgtttttcttcggtacatcagcttccggcaggacatgatttgcaacaacatacatacggcggacaagcagattcttatccacgatccggtcgaagagttctgacacagcacacattattttgcgagtagatgatgtgtgaccgtcgagattgatagagccgtgcgcctgtttcggaatctgcctcccataatgatctgtctcaaccgcgccgtgatactttgcccgtcgtgccggatcggtcaggttctcaatgtcgtagccgactgtgagaaccatttggtcggtgacaagccccttgtccaccaagtccagcacaagcaaatccgtcatctctcggacaaccagctttgctttatccgtctcgtatgggcagtgcaatacctgaccggagctgatgctgttggagctgggacggtacgccttgatcgcttcaatggtcgtaggttcccaaccccacgcatggtcgatgagcaattctgcattcttgccgaacagcttgtaaagcaagtcctcgtttcgctctgaacaaagtgcaacatcgcccatcgtaaacatcccgttttgctcaagtttcttggcaatgcctcgacctacgcgccagaagtccgtgaggggctgatgcgtccaaagctcacgccggaacttcatctcatccagctctgcaatgcggacgccgttcttgtcggcggggatgtgcttcgccacaatgtccattgccactttgcagaggaaaagattcgtgccgattcctgcggttgctgtgatgccggttgtttcaagcacatcgaggatgatcttcatggcgagatcatgtgctgagagcttgtaggtgttcaggtagtccgtcacgtccatgaacacctcgtcgatggagtagactacgatgtcctccggcgcaatgtacttgagataaacctgatagatgcgggtgctgtactccatgtagtacgccatccggggcggcgcgatgatgaagtcaatcgccagagacgggtttgcttgcagctctgagaagaagtgcgatgtgccgtccagcctgtgtcccggcgcgtcgtgctgccgtccgacattcgattccttcacgcgctgcttgacttcaaacagccgtccgcgtccggagataccgtagcttttgagggagggtgtaacggcaagacagatggtcttgtccgtccgactttcgtctgcgacaacaaggtttgtgtccagaggatctaagccgcgctcccggcactccacggaggcgtagaaggatttcaggtcgattgcgatgtaagtgagttgtttcaccttctttgcctccgctttcttcttagatcatccctaatgacatttcattggagcttttaatgttgaatacgatacgccattcaatatcaccctccaccggctcaaagtgtagagaggaacaaactgcatgaagtttttcttttgagctgcctccacacacgattgcgattggaccgtccgctccgccgataatgccaatacaagcaatatcgtttcgtgcctctggtgcatagcggtcagagcatggcgcaattttcaaaggtttgtccccctcagcgcaatcacagattgaaatatcatcgtctggttcaggagaaaacgtatagctcatggcggtaaaatgcgtcggataaagccagcggtcagaaccgaaacgcttttcggaaattgtctgccgctccaattcctgtacggtcaatgtgtatttttttccactgaccggatggaggaaagaaaacgaatcaccgggagcgtgtgccttgaaatgtggtcccgggacacgacacgactgctgctccattgtaagggagagggcttttatttcaggacggcgtttgcttgtccacggaaaagctgcccgaaaaatcatccatccataggatgtatccaaatcatagtgttccaatgcccactttgcttccgcttcattgatcaccccgtctggcaaacatggattaaagaccacggaacagccgtgggaggtcagcattgttttcccgttcaattccaaacgaggaataaagtcaaggcaaagtggattgtctaaatctatctgcatttgctgctcctgcgtgaagtattcgcaggagtcgttttcggggtgtaaatcccatttagttatgaacttgcgaatgtcttcttccggggtgcgcatacaaaagtccatgacgagtcccttgctgcaagaatacgccgcaggaataacccaatgatgcctcgcccagtcaaattgcttattcaaccggatttccgttccggcatggtcttttcccgaatgtccccagaagtttccctcaaagtagaccttccactcaggcatggtcggttctgcttctgggttcatatcaacatcataatagtcctcggtgtacttgatcttgctataatcaaaagatgcttgcagctttttgatgtatacccacggctgttccataggcgtcaatttcattttctcagcaagctctgatagcgttctttgctgatcctgtgttggagggttgtcctgcaaaaaggcttcaaactgggctttatcccacatccacgcctgttccagcgctgccgaatcactgcaagcaaggagcaacctcagaaagtcttcaaaatcgtttgccagcggatgaacaaaatccggagccgagttcatgggactgacggaaaataccataccgccaaagcctcgaacaaagcagaagtggatgccgtccacacccgcccagccaaaaatagatgcaccttttggcgtgcaaaagtatgggttgttatcttcacgacgcttcactcctacggaagagaggtcaataccacttcgcaaaaatttctgaaacactttatccatagaccttatgctcctattaaactttggtcaaaggcaaacagagcctcgttgatctcaaagacgttatagttcccatgctccacgaaatactccacaatgatgtcaaacttgttggagtgggagagtgcaaagcccgccttcatgagcatatccttcatttcggaaagtggcagctcaagagcgatggcaaaagcaatcgctgtgggcttgctcggcttgtagagcttgtcgctgcggatcttcgagaagagcttccggtcaatattcgccttcttatagcactgcgcgtccgtcatgccgcgttcgtcaatcttccgcagcagcatctcggaaaagctctcgtcgatctgttccagtgcatcgtcgagtgttgctgcctttttgggggcagccgccgcaaagacgggaggcatgagctgttcgattgcctcttcacaaacggatgcctcgcaaggcatgggttcttccatccggaaggcgttcatcctgcgcagccgctcagaacgaggatcggtatgctcatccacatagcggtcgtctatgtacgctgcaatgtcggcaaacagcttgccgctgatctgataggctttgcggtcgaaaataacgatgtacaccgtcatttcgttttcaagaaggaaactgctgatggtgtcaatcgcaaccttgagggcttgatcctttggatagccgaaaatgccggaggaaatcagcgggaacgcaatcgattcacatccgtattccttcgccagcatgagcgatgtccgatagcaggagatcagcagttcgcgctcaccatgccgcccgtcataccagcgcggaccgactgcgtgaatgacatatttgcagggcagacgatagcccttcgtgatttttgcgctcccggtttcgcagccgtggagcgtttcacattctgccagcagctccggtcctgcggcacgatgaatgcagccgtccacaccgccgccacccagcagcgactcgttggcagcgttgacgatggcgtccaccttcatttttgtgatgtcatttctgacgatttgaagcggcatgatcaagccctcccattcggttacttcgcgccggtcagcagtttgtccagcgggattctttccgggtattttccttcggtcagaatgtcatataaatacctgttatccagaatcatatcatcccggataagctgccagtttgcctttttcctgaaaaacaccttgaagatcaggaagttcataatcgccccaattaccggcgtggtcatgccgaaagcctcggtgtgagagaaatggcatcctgttttggttcttttcccttcaaaggtgatgaacgccgttttcttgtcgctccggaatacaatgcggaagtggttctcatcctgttcgcattccgtaattgtgccggtcacatcgtagtccagccccatgacgatctcgcggaagcggatcttgcttcctgcgttatagtttccgttatagagattgcattcgatgtggtagggactccatttcacaaactcttcctcaaagttagcagtccatgcctttaatttttcataggaagccggaatctctatctgctctgtaagaacaatcattgtcagtttctcctattctgtcaaagcggcatcggtgtccgggcgatcagaatgaccgccagaatcgcacccacaaatgccgcagcccctatgaccgccaacaactttttgctgagtttcttctttgctgccttgccaatcagcgcagcgcaagccacgcagacagccgcagccacaagtgcaatgcccagcgtttcccatagccacgaaagttcatgtagtattttcatgcgatcatcatctcctgttcgttaaactggaatttatagtcctctcaaaaccaatttgctttttcttctcgaaatacgggaatatcactatctcgatatggattgtaattatgaagattgcaaccaaactcttttaatgattttattttgttatcctgtgtccatacaattaaagatattccgtcaaattcttcaacatttccattattcattttgtttttaaaataccactccacgattgtttgattgccttgatgaaaaaattgcttaatctcccagacaagaacacttccgcgtgtattccattcgtcaaaccagtgctttaccgttttgcggttttcatatttaggactccaactctcagtatatacaacatcatctgtaaaaatattgtcaattcctaaatctgctttcttaatccacatatcaaaccataatcggataattttttctctctcgttcataaagcacctccacaacttccgatttgtctgccccttaaagtccaagtccttcaacccacgccgcaagctcctgatgcccgacgcagcccttgaaaaccttgccgtccatcagctttgcgcctttgcagctcggcgcaaggcgttcgttcgtcttgccaatgtcgcttcctccggaggttgcaaacgggatgatcgtcttgccggtcatatcatagctctcaaggaacgtattgataatcgtcggcgcaacgtaccaccagatcgggaagcccacaaaaattgtgtcgtagtccttcatgttgtcccgctttatggcaatctctggacgggaaacaggatcgttcatctcaatcgtgctgcgggctttcttgtccatccagttcagatcggcttccgtataaggcactttcggctcaatctcaaagatgtccgcgccgattgcctctgccagcgtctcggcaacctttgcggtcacgccggacgcagaaaaatacgctacaagtttcttactcattgtgttcttcctcatcaatcttttcatttccttcattcagcatgaagtatagcagagcttccagcaatgttgccatataatgaagcgaccagttttcttccggctcttttgtcatcttatcaagcacggctcgaaaagccgtggtacggtcaatccttgtttcatcatcaatgcggtcaagtatgcccttcattttcagggcgagttctttttcctcgtcagaaagctccggtatgccaagtaactcagatagtttcttgtcctgcataatagcatcgtattcgatgtatgacttgtgttcggctgacatcaattcttcaaagtagttgataaaaatatgaacgcgaatgccaccttcttcgtccggggagaagcagacggtttgcgatttttctgcaatttctttcaaaaatgcaaggtcttctgagtcatcgaactccgcaaacggaagaaacatattgatttccgcgtgccaacgatgatagtccacgattcccttgatatacccgcggtgttgcttgacaaacgcatcacagcgttccagaagatactcgtagttcttcttgtcctccggtacaatgatctttggtatcttgtccattgcttcggagtacgctttcagcataccacaattaactgcgcggtcaaacacctcatcgcaccatttatcgtattcggcagactcggtttcccggtaatccttctcaaagataatatcgtccattgcgttacccctttatgattttctcaagctgcatttcggtcgcgttaggcagacgtgattgcagatgttttagaatgcgttctttggattcctgcgggtctcgctgataggcagatgtgataaggtcgtacccgaaaagttcttccggcgtcgcatactctgcgacaccccagccataaggtcttccgtatctgtcctgcatatagacgaaatccgcgatgcagacatagctctgcatttgcagccgcgtgatgcacgtctcaaaaccggtgttgccgcccttgcggtagttcagagcctctttcagccgtttggaaagcattctgccttcaccggctatggcttcataaagctccttgtccttgtaggacgccaagccgtcatcccaacgggcgtcaaagtcatagccgtcacgccggaagttcgcaaagtccggaatccactcccgactcacaaatccagccttcttgttgaaaagtttgccgtaaagacatttgccgctccgcgcagccggtcctttccattcccacggaccatctacatcatccgcaaaccataactcaggtgggcaaagttcctcgatggagaagccgtgaatctcgttccgaaagaagggcagaaagccgtattgttcgacggcggcaatcaaaccatctgcactatgtagttgtctggcatatctctttgacattactccgcctcttcaatcacgccataatcaatcaggatgttcttctccgcatactgcgggtaaacaacacccatcatctcatactgataacgtcttacgcggcgatgctcctgaattggttccggtgcatacgcagcggtttcacagtgcgcatactccggcatttccgcaagatcatcccgaacatcacggataagcgcttctgccacatcatcaatgttcttgccggtctccacggcaaccagttcgtgcttccggactgccttgtccagattaccgggggagcgaaacagcttatatttcatatcgttgcccgtcctttctctctttcggtctgcctattcttcctgaaatctgttctttagggacgcaatcatcgcttgtgcggcaatgctcagatacaaaactccaatttcatagataaagtcgcggtcgatcacgataaagtattctctaacgtgtgtaaaaaccagttccagcaagtccctgtacagcggatcatcaaagggcttgaaccgcgtaaacttgcttttggcagcgtcccatgtcatagacgcttcgccctcagcactggtcattgcctcacagagaatcatgctgacgcccatttttccgttgccggtcaggagttctccttcgtaatagctgagtaggtctttcttgcgtcgaagcggaactacatcgcagttgtcatccagctcaaatgcaatcagctccgcaatcagttcccgccagaccgcataaccggcgttaatggttccgtcctcttcgcggctgatggtatcgtccatgcagtatcgctcaaagaaattatctccgtcaatctcgttgcgggtgcagaagatatgcgccagctcatgcagaagaatgtgtttcaactctgccggatgacgcgctatgtctgtgcgcagaaggattccgtccgcgccgtctcctgtgccgacgaatgcagaggcgtgaaagtcaaaatagccgtcctctgtatatcggtcttccagccggtcagggaaatactgcttgcagaactgctcaaagacttcctgctggttttccgcctgaaagcagcacagcacaaggttgtcctcgctgaactctgccccaagcgttcgttaaagatggaagcggcatagaaaagggcttctttatagtcgttatcgttcatctaattactatccttcatcctcattcaaccctccggtctgacatttttcaggaagtcagagtgcggtacataaggcaagttgagctgccagcccatgcggttcagctcgttgagcttgatcagcatcaggttgatgtttgttcccattgcagccgagagctgcaccacatcgtagtcctgcttcatcaggtcaatcagctcatcatcgtcaatgatcaggtgtgaggcaaacgcattcgcctcatattcgtgttttgtgcgcatatcgaacagcacgaactccgggagcggttcgtttcctttggcaagatcacggtgaaaggtatcatgcccgatctcgtgaccgcaaaccatttgcatgatcagatactccatgttggagttcagaagaatatgccgctctttatggcggtaggtgtacattccgagcagatcgttcagattgtcaagaaaatggagatgaatgcccagctcacgggcaatcttcaaggtatctcttgttccacagcttttgacaatgctgttcgcctttttgtatatttcctcggagcgaattatcacgggaccttcacccctttcatgttgaaaacagtcaaagtaaatccgtcaagaaaccgagacgcagacagttattcctctgcgtccgtaccggtcttcttgtatttcttcggcgtgtatttctcaacattccgggctttggattcccaatatatatcctgcaacgccttcatcaccgcatccttgtcctgctcagacagcgtaccgcccgcaaacaagccggacatcccttcaatcaggtcctttgcctgtttcatgccacgggagccgtactgctcggatgcctgaaccacaaactcttcgtcctcggtcagcagatagttcacatccaccttgaagtattccgcgatttttctgtaagcgtccttggtacggggaaaggaaatgccgttctcgtaccgggtaatcatacgtctgttgattcccagtgcatcggctacttcctgctgggtcagcttccgcttctcccgttcagccttgaatttctctccaaacgtcattttggtaatcactcctgttcacaaaaagtttgcgacatcaaattgcgcaagtctattgacaaaggcacttgaagtgcgtataataatgactgagcaatctaactactcatagtatatcttgaattgctcatcctgtcaaggggcatgagtagttgtacacgaaaaagttacatcttttgagcagttcaaatggacaggcatttatgctgccgaagattatccgtaccggcatacaccggtatgagggaacaggagtgagaaaaacagaaatggctacacagtacagaaaagcatacgtcccggttacgctggatgtggacaaggagggggcaatcctccctcgccttatctggtgggacaacggtgtaatctttcaaatcgaccagattctatacaaatgccgcgccacatccaaaaaggttgggggcggaggcatccgttacacagttcagattcgcggaaaggagtcatttcttttccacgaaggagacaagtggttcgtcgaagcaaaggaggacaactgctcatgattttatcccagcgccaacttgaagaaattgcagcctcaacaacgaaggacttcaaccggttctttttcggggatgaggcggacaagcccgaccgatcagctttgccaacacccattgatcagtttgcaaagaactatctcggtcttcgcgtatcattcgcccgtctctcgccggacggaagcatctgcggtgtcactgcctatgccgacactgagtacaagatcacggaacttggtattacgcgcacactggctttgaagcgtaatcaaattatcttggacgagagcttcattcgatccggcaacgtgcagcggctctgcgccaagcgcagatttacccttgcccacgagtgcgcccatcagattctcttccaactggaatcggaagaggtaaaggcgtcctgcgaaatgaaatattccgcacggacagcctatacgccgcgagagctgaaaacccgcgaggactggaacgagtggcaagcaaatgtcttgggcgcggcgatcctgcttcctcaaaaagaggttgacctggcaatgcgtcggtttgcagaaacgccgctgatcaattacgaggggaggtattcgtatggtgatcacttaacgctgcgccttttctgccgtttgttcggtgtctccaagacaacggcgtctatccgccttcgtcagctcggctacatggtagatcgtccattcagtgagtatgttgacccattggaggtgtggtaatgaagagagcatccattcgggttcaggaaccgacgccggagctgatcgaaaaaatccgcagggcaagagttgccatttcccagcagaagccccgatacctgaaatgtccctattgtcagcataatgccattgctgtctacgaggacacgaggggtcatgtagaatccaagtgcaagaaatgcgggcggatcacagtctttgatgtgctgaatatgagaagactgcgaccgcgtaccaagtaagaaccggaggacaagcctctgttctaaaataaaatatatgtcatagctgagctgtggagccgcctgataggtgaagtcatcctaatgccgcatgagacagagtttaattgctctgttttatcggcatgggattcaaacctcaccgtcatgcggctctttttctgtcttcacccttcccgctgctcccgcgcagcggaaaggatgaacaatgaaaatccctaagacccctatcgcgttcgattacgacctctggactacggaggacggcaagtgcatggtgcgcgtgaaacgaaccggcgaagtttccgaggttgaccgcaaggttatgagaatccttcgcgcagaggaaaagcggatcagacgctcgtatggctctgacaacacctctgaggatgaggacggcgcagagaaaatttctgacaccgtgctgtcccttgacgctatgccggaggacgatgtgaagtccgctgcatggctggcagactcccgcgactgcatggaggaactgatcaccgccctcaaagagaaggagcttctttccattctgaccgagaagcagcgcgaattgtatcttgcgatgacccgtgaaggactgactcttcgagagtttgcccgaaggaaaggcatcggcatcagagctgcatttgacctcaaagcagcggtgcagaaaaaatttcaaagaattttttgagcggtactcaacaaacggcaaaaagatgtccgttgtaaagtgaaagggtcaatcagaccacttcactgctccttgaaaactgaatagttcagtgctgcggatctttccgcttctgcgaagcaacacagcttccgacgccaagacctcccgaaagggagtgagcgacctccggagagctataacagtcgtgtggtgcggctgcttgcgacgatgcagatgccgggtataatgatacttccgtcttttctttgaatgggcggctcggagcgatcctcggaggggtgagagtcccatgataccgattgaccattggtagtccgcagcattcccggaactgcaaagttcttctggcaggggcgcgagctgcaaatatgccggacaatgaaacaaacccaaaagaaacttactatatagtttcaggatgaaaactatgtggcagggtatcttcacaagatgctctgccatatccttttgtcctgaatatttcacgaaacaggaggtgcttagaatatgatgggcattgaaacaatgaaaagcgtcagtccgaaaacggttgaccgaagcacactcgttcagagaagcagcatccggcttgatcctgcggcaccgcgagaggacaggctgagggagttcatcaagcagatcagaaatccctattgttatctggacgggaaaactgtggtgaagatcagcttcgccgcgacggacacgacaatggaagattgtctggaacactatctgagaggtctctgatttatgaacagtctgaatcttttcacccggttctatggacaagcgattgagcctgtggtataatgaaatcggtcaaaaaagaagaatacggattaagccgcttgccctgatggtcatgtggcgttttcgtgtttctcttcataagagttgaagcaagccttcgtctttctgatttgatgtaccacaccaaacagaaaaacggaggttatttttatgccagacaaggtttaccgcacggcgatctactgccgtctgtcccgtgaagatggagacaaagtagaaagcaactccatcgccagccagagagccatctgcgaggactatatcgcaaggcatgaggatttggagcttgtctgtgagccgtttgtggatgacggttacagcggcgtttccttcaatcgtcctcagttcaaaaagctggaagaggcaatccgcaagggtgcgcttgactgcatcgtggtcaaggatctcagccgcttctcaagaaactacatcgacggcgggcgctacattgaaaagattttcccgcagcttggcattcgcttcatcgcaatcaatgatgcgtatgacagtctgaccggtgatccgcagtccgactcctttgttatcccgttcaaaaacctgattaacgattcttactgcaaggacatctccatgaaaatccgaagcagtttggaagtcaaacagaaaagtggtgagttcgtcggctcgttcgcgccttacggctacatgaaatcgccggagaacaaaaaccagctcatcgtggatgaagcggtcagcgaatatgtgcagatgatcttctccatgtacaaggacgggttctccattgggcgcattgcaaagcgtctgaaccagatgggcgtcctgtccccgatggaatacaagcattccgccggtgtgaagttcgataccgtcttcaaaaccggcgataccgcaaaatggacgtacaaagccgtccagcgtattctcaccaacgaggtttatatcggcgttctggctcaaggcaagcgcggcactcccaactacaaagtccgcgtcgtgaagagcaaggacgaatccgagtgggtcaaggttgagaacgcgcatgaagctcttgtgtcctacgaggacttcatggcagtcaaggtcatgatgcagcgggatatgcgctgctcacccgatcaaaacgaagcacacctgttttccggcttcttgttctgcggagactgtcagcagccaatgatccgcaagaccgtcccgtcgaagacgaaaaagtatatctactacgtctgctccaccaataagcacagccggacgtgcagcccgcatagcatcgccgcaaaagaggttgaagagaaggtcttccgtgccattcatgaccagattgagcttgtcatcaatctggaacacgcgcttgcgatgatagaacggcttccgtctcagagccgtaaggctttcaattacgaagctcagatcgccaaaatcgaggaagagattgaacggtaccaaaagctcaagctggggctttacgagaacttcatcggcggcgtcattgataaaacggaatacttcgagttccgcaacagctacaccaaaaccattgagggcaagcaggacgcgcttctgcgggttaaaaaagaaatgaagcagacggtgacaaccggcacgactgaacggaactgggtaacgctttttaagcagtatgaaaacgtcgaagagctgaaccgccgtgtgctgatgtcccttgttgaccgcattctgattcacgaaaaccatgcaatcgaaatcgtcttcaaatacaaggacgaataccagcagacacttgaatacgttctcggttatgccgacgaactggatattgccgtataaaggaggaatgagcaaatggcaagaaaaagcagaaagcaaattgcagttgaagagccggttatcgaatctggctcttccgaggtcttctcaacagccatctatgcccgtctttccgttgaaaacagcggcaagtccgaaaaggtggatgtcatcgcaaatcaggttgagatttgcaagtcctacattgcagagcgtccctacctgaatctgatagatacctatgtggacaacggacgaacaggaacggtttttgatagaccggagttcaaccggctgatgaacgacatccgcaccggcaggatcaagtgccttgtagttcgtgatctcagccggttcgggcgtgactacatcgaggctggaacctatctggaacgggtctttccgcagatcgggcttcggtttatcgccatcaaagagaactacgacaactttgatacggacggctccggcgaaagcctcatcatccctctgcaaaacatgatcaacaccctttactcgaaggacatctcccgcaaggtttctaccgcgctcaaggcacagatggaaagcggagagttcaagaagcgcaatctcccgtatggttatcgctgggatgaagaacacagcaatatggtcttcgatgaggaaaccgcaccgattgtccggaagattttccaatggaagattgaagggctgtcccttcctgcgattgcagaccggcttgatgcaatgaacgcgcccaatccggagtttcagaagtatcaggtcggcgtccgcacaggcaatgctacggcaaagaagatttggaacaagtcttcactgactaccattctggataatccccattacgtcggagataccgttctcggacggacgctgaacgccatctataagggcgtcaagaatcagcatatcgaccgcgaggaatggattgtttttcccaatactcacgaggcgattatttcccgcgaggacttccaaaaggtacaagagctgcgcgacgctgctgcaaggacaaggattgagaagatggagcgcacggagaaaatccgtgctacactgatcaatctctttgaagacaaaatcatctgtgcagattgcggcaggaaactctatttccatcgaaagcgcgttgacaagcgtaaggacggcgcatggtacgccttctatgagtgcagctcatccgtcaagcgcggcaatctctgtacgccacactatacgcggcaggacaaactcgaagccgatgtgcttgcggcgatccagcttcaagtcaaggcggctctcaattacgacaagctgcttgccaaactgagaaacagcgaaggtgaacgcagcatccgaaatcagcagaatgcgctcattacaagcctgaatctgaaactcagcggtatttccaagaagcgtacccgtctctatgaggacttcacggaaggcgttctcgatgaagaggaatacgcctttgccaagaaagcctacgatgagcagtatgccgatctttcccggcggttggatgaagcggttcagcggaaggtgaagtttgccgaggcaatgtccgaggacaacaagtggctcacgctgatgaaatccgtcagcggtgcagaaaagctctctcaggagttggttgacgagtccgtagagcttgtgaaagtccatgaggacggctcaatcgagctggtcatgaaatacggcgatatttacgctctgaccattcagagtatcaaggaagtgcaggaggcgatgtaaatgagcaaggaatacaacatcggcatctacatccgcctctcaatggctgatgaagataccggttatggcagcaaggcggaaagtgacagcatcggcaaccagcgtatgctcatcaatcgctttctcgacaatcatccggagttgtctcactgtcagcggtctgagtttgcggatgacggttataccggcacgaactttcaccgtcctcagttcacgcagatgatggagaaggtcaagcgcggcgaaatcaatctgatctgcgtcaaagacttttcccgcttttctcgtgactacattgaaacgggaaactatctggaatgcacttttccattcatgggcgtccgctttatttccatcaacgacggctatgacagtgacgattacaaaggcacaacgggcggcctggaagtggttatgcgcagcatcatctacgccgcatacagcaaagacctttccgtaaagaccacatcggcaaaaatccagatgatgaagcagggcaagtatgtcggtggctacgccccatacggctacgtcctgcatcccaccattcggaacaaacttgccgtagacccggaggcggctgatgtgatccgtcgtattttccgcgaggcgctggaaggcagcaacacctctcagatcgcccgcagcctgaatgatgacggcatcccgacgccggggcaatacttcaagagcaagcatcccgacaagaagaagttcagtaacatgagcgagaaaatcagttgggaaaccgtgatggtctataacatcctcaaaaaccttgtttacaccggaacactggtcagccgcaaaatgaagtcctgcggtgtcggctcaaaaaagcgtgttgtcaatgagccgattatcgtagaaggaacgcatgaagctattatcagcaaggaagactttgagcttgctcagaaggtcattcgaggcggaggacggaatcccacgcgcaagcagcatgactatccgctcaagggactcgtccgctgcggtaactgtaaacgtgctatgacacgccgaaagaacaaggctggcattcggtacttccagtgcattcactcggtcaacaacggaaacacagactgtccggttggcaggagctttccggaaatggatattgagaaggttgtcttccatgcccttactcagtttcttgctttggcacagaaggaagcaatacagaaccgcgaagtcggtgatctgcggaaatctgccatcaaggaatgtgctgataaaatccgcactctgcaaaagcagaacgagcagaacaaggcgtccaagctgaggctctacgagaagtatgcagccggaagcatcacgaaggaggcgtacattcagcagaaggcggcagcggatgtgaagattgctgaaaacgatggagcaatccagcgcggtcacgagcggatgaaggagcttgactccgagaccgcctgttcagatgaaaagctggatgcggtctgcgaacagtacgccgactgcaaagctctgacctatgagctgacccacgcattcatttctgcggtctacatttacgatcttgacaacatagaaatcgtctggaagttcaaggacttcctcactacatcagaaggagaagccaaatgaaagtatttctttatatccgcgttgcctgtgcggatcagcttgcggcagcagaccagtgggaagagctggaacgctatgcgaaggacaaaggctatgaggtggctgctgctgtggcggcagacggcatctccgccgtccatacggaaggtatcatgaacttcctgctgaacgaagccaagcgtcaggacatcggtacgatcctcacccgcgacacctcgcgaatcagccgggacacttcctctttcatgaggtttgagcgaaagttccgggagaacggcatccggttcgagtatctgtccaagcctgacaacgagcttccggtcactccgatgttggaggcatttgcggcggcgtataagaagcgtcgcacaaagaacggcacaagagcgtagagaaaactcaagccgttcatgggtggttgtccacctatgaacggcttgtaaattctcaaaatttttttagtccctacttgacacaagaagatgtaagccgtcaagtacgctgcccaggcgcaccacagccccggccgctttcggacgagaaagcagatgatcccgcacaccagaaacggaacggccaggatcaggccgatgaggatccccccagccccgtggggatcagaaacgccagaaaggccatgcagaagaggatgatcccggcgatcttccgacccggcattgacggagacaccatgaccggaggcgtctccaccttcactgggggctctgctcccgtcaccagttcatccagcgtcacaccgaagagctggctcagcttcatcagcctgttcaggtccggcacactggaatccgtctcccacttactgacggactggcggctcacctccagcacttccgccaggtccccctgagacaggcgtttctccgcccgcaggcggctgatgttggttccaaggctcataccgcgccctcctttgtggttccagtatagcgggagggtgggcaaaagtccaccaaggggacctgaaaatttggcaactgccagttgcacattgccaaaagcccgaaaaacaggcagtcccgtcggccttgcttgacgagaaacagaggaggtgctattctaataaaagaagaacgacgggagggattgctttgaagctggcggagttgcttgacatccgtcccggtgtcactgccgtcatcggcggcgggggaaagaccactctcctgcggaccctgggcgaggagctggccggacagcatccggttctgctgtgcaccaccaccaagattctcccgttttcggacctgccctgcgcccggacagcggcggagctggacgaactgcgcagggcgcatcagctgctgtgtgccgggacagacgtaccgggaacgggtaagctgacggccccagagacgcccatggcggtgctggcggagcaattcgactacattctggtggaggcggacggcgctgcccgccgtcccctgaaggcgcacgccccccacgagccggtgatcccaactgaggccaatcagaccatctgcgtggtgggggcctccggcttcggccgtcccatcgctgcggccgctcaccggccggagcggtacgcgcttcttgcgggtgtgccggaggcggcggaggccacgccggaggccgaggcgagggtgcttcgatccgaagatctgcacacgaaagtttatgtcaatcaggtggagacgctgtggaatctggcagatgccagggttctggcgcgcctgatggactgtccggttctggccggcagtctgtggaggagggagtattttccatgctggtaatcatccgaggcgccggtgatttggccaccggtattgctctgcggctgaaaaaggcgcatatatcggtgattatgaccgatataccggccccaactgccatccggcggaccgtagccttctcccaggccatcgtgttgggagagacaaaggtggaggatgtcaccgcccgccgggcggagacaccggaggcggctatggcccttttgcaagagaatgtagtcccggtgctggcggacccggaggggatctgtatcccagttttgaagccggacgtggtggtggacgccatcctggccaagcggaatctgggcacccggatcaccgatgccccggtggtcatcggcgtggggccgggcttcactgccggggtggactgtcacgcggtggtggagaccatgcggggccacagcctgggccgggtgatccatgcaggcagcgcgctgcccaataccgggatcccggggctcatcggcggctttgccggggaacgagtgctgcgggccccggcggacggcgtgtttcaccagctgctggacattggcgcccaggtgcggcagggggatgtggccgccacggtgaacggcgtgcccatgacctgcaccctggacggcgtcctgcggggtatcctgccggatgataccccggtgcacaaagggatgaaggccggggacatcgacccccgctgcaaggtggagcactgctataccgccagcgacaaggccctggccattggcggcggtgtgctggaggcgattttggacctgacgggagcgctgaaagaccgcgcaggtgggtattccggttaggtgcagcctgtcggggacgatcaaactgaggaaacgggaggaagaatcatgcctgaaaatgatgtcaagctgacgaagctggccaagtgtgccgggtgcggcgccaaagtgggggccggtgtgctggcccagctgctggacggcatccaggtgcatcgggaccccaatctgctggtggggttcgacaagagcgacgacgcctcggtctataaggtcagcgacgatctggccctggtgcagacggtggatttcttcccgcccattgccgacgacccgtacctgttcggacagatcgcggccaccaacgccctctccgatgtgtacgccatgggcggcgagcccaagctgtgcctgaacatcatggccgtgccggagtccatgccgaaagaggcggtgcaccagctgttgcgaggcggctatgacaaggtgtatgaggcgggggcgctcatcaccggcggccacagcatcctggacgacgagcccaagtacggcctggcggtcaccggcttcgtccatccggaccgggtgctgaccaactccggcgcccggccgggggacgtgctgttgctgacgaagcccatcggcattggcgtcctcaccactgcacagaaggcggagatgctgtcggtcgaggggcgggctttggcagaggaactgatgaccaccctgaacaagtccgcccgggacgccatggtgaagtaccgcgtccacgcctgcacggatgtaacgggctttggcctgctgggccacagctatgagatggcccagggcagcgatgtggagctggagctggaggtggacgccatcgacctgattccggaggcgctggagtttgcaaacatgggtctgctgccggcggggatgtaccgtaaccgcgcctttgcggaggcgggcgtggatgcaggggagaccgcgctgtgcagacaggacctgctctatgatccccagaccgctgggggcctcctcatggccgtggacccggcggacgcggaggcgctgtatcgggagctgcagggctgcgtccccagtgcccagcggatcggcgtcgtgaaggcctaccgaggcgggaaacgcatcttcctgcggtgaaagtcgaaaatgggaaacaggtgcctgccggatttctggcaggcacctgttttgcgcccgtaccgggcggaacccttaaacgggcaggcgcaggagcgcggcggcggcctggaagtagatcagcaccgccccggcatccacaatggtagtgatgaggggggaggccatgatggccggatccatgtggagctgcttggcggcaatgggcagcatacagcccaccagcttggccagcaccaccgtggccgccagggacagggagatcaccagggcgatggcgctgtcatggtactgaaggtagatccgcaggccgttggccgcggctaggacggcgctgacgatggcggctaccgccagctccttgcggatcacccgcagcgcgtcccgggggcggatctcttccagagccagcccccggatcaccagcgtggcgctctgggagccgcagtttccgccggtgtccatcagcatgggtagaaaggccaccagcaggggcacggcggagatggcgtcctcgtaccgggtgatgatagagccggtgatggcggcggacagcatcaaaatcagcagccacactacccgatggcgggcgtgctcccaggcggaggcggcgaagtagggcttctcgtccggcgtcaccgccgccatgatggagagatcctctgcggcggcctccgtcaggacatccatggcatcatccacggtgacgatgcccaccatccgctcctctccatccagcaccggcaaggccagcaggtcatatttcgccaggagccgggcggcctcttcccggtctgtgagcgtacccacagataccacatccgtgaccatcaggtccgccacagcggcatcctccgcggctgtcagcaggtccttggccgacaccacgcccagcagctgccggtgctccagcacatagcaggtgtagaccgtctccttgtggattccggtgcggcggatggtatccagcgcctgccggaccgtatcgcccggccggagggagacaaactccggcgtcatgacgctgccggcactgtccgccggatagcgcagcagggcatttaccgccatacggcgctgagggctggcggagcggaggatgcgggtcaccaggttagcgggaagctcctccagaaaatccgccgcgtcgtccagatgcagggcgtcaaaaatctgctgcagctccccgtccgcgaaagagcgggccagggtggcctgagtgggaccggggagataggagaacacatctgccgccaggtccttgggcagcgtgcggaacaccgccgcctgccgggcaccgtcctccacggagtccaggagggcggcgatgtccacggcaccgcggccctgccaaagggcgcggagcgcctcgccgtcccggctctccaaaagctgaaagatctgatccttgttgaacatggtcatagtcgttacctcgctttcgtctgtattgtctgggtggctgactggcactttccatggtccgcacctcctttctgcataaaactctatgcgcgctcgcgcgttaggaacatcggctgtgtgaggttttgcgcatcctttccagctgccccgaagggacggggaaatggcgcgtttgaatttttggccgtgcttttccgcagcaaaaaaatccctgccggaaatccggcagggagagctgcacacaatgggcgtcttcgtccaagctttagcttcacggggcgtagcaactgcgttaagcggcgccttgttgtcgacgcggcctgttgaccagctggttgtgtctccacaactgtgcggcagcagtctttggatgattccgaatccccgtggtagcctcacctaccgattcgccgtcattataaccgcctggacggacgtttgtcaaccccgtcgcctcaaaaaatttttcgccatggcctcacagcgccttccggtgctggttcatgatacgggcgaacagcacgccgttggagggcggggtgtatgtaatggcattggctccggcctggatggtgcggaggatcgactcctctgtggggccgccggtggcgatgatgggaacctccgggaagtcccggcggatctccgccacgatctccggcgtggcggcggcgccggagacattgagaaagtcggctcccgcctccaggcggctgccgatgtccgtgtgagcggagaccaccgtgatgaccacgggaatgtccaccacctttttgatctggcggatgacatcgtcggaggtgggggcattcagcaccacgccgtaggcaccctggtgctcggactggatggccagccggacggagcgggagccggtggtgattccgccgcccacgcccacgaataccggcacgtcggacacgctgatgatggcctgggagatcaccggctggggcgtgaagggatagacggcgatgatggcgtccgcgttgatgttcttgatgatggctacatcggtggaaaaggccagggacttgatgcgccggccgaaaatgcggatgccgctgcactcgctgacgcaggcggggatggtcagggagtgattgcgcagcgtcccagtgtaggaggggacctgttttgccatagggactcctttctcctggcggcagaccgccgggcacaggtggttgttcacaggcaaattataccgcaggaagccacgcgggacaagcccggatccgggcttgctttttttccggcgggagatatactgttaagagacgagatgtgtcgggacggcacaggggaacaggaggacggctatggatcgcttttccattctggtgggagatatcacccgttcggacgcggaggccattgtcaacgcggccaatcccacgctgctgggcggcgccggggtggacggggccatccacgcggcggcggggccggagctgctggcggagtgccggacgctggggggctgcgagcgggggcgggccaagctgacggcgggctaccgcctgcgggcccggtatgtgatccacacgccgggtcccgtctggcagggcggggagcagggggaggcggccctgctggcctcctgctaccgcagctgcctgcttttggcggaggcccacagcatccgcaccctagacttctgctccatatccacgggagtctacgggtatccgttgccgctggcggccaccgtggccctgcgggccatcatggacttcctggcggaccatgccctgccggagcgggtgcggatggtctgccattcggagcaggcggcagaggtctaccgccggacctggaacctctggtacgcggagggcaaggaccagcggatgtaaagaacgccggagcgggacctttcccgctccggcgtttgtcactcttcgtttcttttgtcactctttttgacctttttgtatccgttttgacccgatttttcccggggcattccgtatgatagactcaaataagagatgaaagaaaggtatcccatcatgaaacgactggtttcccttctgctgtcctgcctgctgctgagctcctgcggcaccattgtgacccccgccaagaccccgccggagcatttggtgtcagaggcgcccccggctcaggttctccccgctcccggcgagatgccggagctcctcccggacagccaggaggcaggcggggagaatgcttcggagccctccctggaagagggtggcggaactcccgtggagacgctgccggagccccagcgggtggtggatcccacccgccccatggtggccctgacctttgacgatggtccccacgcggtctacacggaccagattttggatattctggaggagcacggcgcggtggctaccttcttcgaagtggcgcggaatctccccaaggcgccggaggcagtccgccgggcggcggacatgggctgcgagatcggcagccactcttaccgccacgcaaacctgggcaagatggatcaggccgcccagcaggcggatcaggccgcggcggacgcgctgtttcaggaggtgctggggaccacgcccgcgctgctgcggccgccctatggctccatgaacaagacgctgaagaccacctccggccggagcatcgtcacttggtccatcgacacggaggactggcgctccaaggacgcggagaaggtggtggccggcgtggagaacgccgggaatctggacggacaggtgatcctgctccacagcatctacgagagcacggtggcggccacggaggtcctggtgccctggctgctggagcagggctaccagctggtgacggtcagcgagctgatccagctgcgctttggggacgaggtggagcccaaccgcacctataattacgactacttccgcttccaggtgccgcccctgcctgcggagacggcgcccgccgccgcatgagcggcaggcaaccgacggttgctttacgccgctgccctgctgtgatagactggtcccgaggtgatgggaatggagtttcaagaggtgttcgcccagctgcggcagcggacgggtctgtcccagagcgaggtggcggagcggctgtttgtcacccggcaggcagtgagccgctgggaacggggagagacgatcccggaggtggagacgcttcaggcgctgtcaaggctgttcggcgtgtccatcaacaccctgctgggcagtccccggaccctggtctgccagagctgtggaatgccgctgaacgatgacatcctggccaaaaacacagacggcagcttcaatgagcagtactgcatgtggtgctgggatggagagggctttgcccaggactgcaccatggaggagatggtggagcactgcctgccccacatgcccctgggccggacggatccggaggcgtgccgcgcctatatgcggagccttctgcccacactggggcggtggaaagagaactgacacaggcgccggactgcggaaacccgcggtccggcgcctggattttttcaggacagctgcgcaagacagctttcgcacacatagatcccatgggggagctgcctgagagaatccgcagcatggcagcagatgcaggaggggaattctttcttcaggattaccgtgcgggatttttcatccagaaaaaacattacggtgtcccgctcatttagagacagagcccggcgcacatctatcgggatcacaatccgtcccagctcgtccagccttctcggtattcccacgtttttcatatctgacatcctcctttttcgacaatttgcggttctatcatactaaaattccagaatatagtcaatatttatatgaaatataggatgttcaaactggaataactcatactatacactgtacctgaaatggggtatggtgatgattgatacaaaagctatcggaaaacggattcaggcactccgcagggcggctggtatgacccaggagcaagcggcggagactctgggaatcagcccaaattatgtgtccaatattgagacgggacgagatatctgttctactgttgtcctgctgggcatggcgaatctctaccacgccagcgtggattatatgttgggggagagtctggaatacaaccggcggaagggagaagcgggagagaatcggacggcgctgctccacgaggtcagacgtctgcaagaggcggagtgtggccatctgctgcggtatatccagttgatgcgggcggacgagactgaaatccggaattgaacaaccgctcctttataatttataaatagaaaagagccgctgcatcaaccgatgcagcggctctttttacgcctttgccagatacgccccgcaggcattccgggcatcggcggcggttttttcctcgtcgatggtgacgagatgcccctccttcaccacgacccggccgttcaccaccgtgtagtccaccgggccgcggaggcctaccgtggccagcacgtcggcgggactgtacgcgccgcccaccagctccagtcggcgggaatccaccaggaagaagtccgcgcacttgcccacggccagctgcccgatgtcctcccggcccagcagccgggcgctgccccgggtggccatcttcagcacctgatacccggagggggccttctcgctggaggtcagccggtggagcaggtagcacacccgcagctcttccatcagggacgacccgtcgttgctggcggagccgtccaccgccaatcccaccgggacgtccagcgccagcatctccggcacccgggcgacgccggaggccaacttcatgttgctgatggggcagtgggccacgccggtgccggtgcgggccagctcccgcagctcctcgtcgttgaagtggatgccgtgggcgtaccacacatccgggcctgtccagcccagagatgccatgtactccagcggccggacgccgtagtgctccagggtgtagtgctcctcgtccctcgtctcacacaggtgggtgtggagccggacgccgtactgccgggccaggatggcgctctgccgcagcagctctccgctgacggagaagggggagcagggggccagggccacctgccgcatggatccgaaggacgggtcatggtacgcctcgatcacccgggcggagtccttcatgatggcgtccaccgtctggaccacgctgtccggcggcaggccgccgtccttgcgggagaggtccatgctgccccgggaggcgaacatccgcatccccagctcctccgcggcggcgaactgggcgccgatcaggtctccgcatccggcgggaaagacatagtggtggtcaaagcaggtggtgcagccgtgcttcagcagctcccccatgccggtgagggagctgaggcgcaccacctgctcgtccaggcccttccagatctcatacagggcggtgagccagtcgaacagctccagattctgcacctggggcaggttccgggagaacacctgatacaggtggtggtgggtgttgatgaggccgggatagcaccagtaatgggacccgtcgatcacagtgtctgcggtctggggcaggtctgggcccagaccgcggatgatgccgttttcgcaatagaggtcggcgtgctccagcacggcgtcgccgtcatcacaggtgaggatggtccgcagattgcgcagcagcaaagaggacatggcggtcacgctcctttctgctcccagtataaaggacggcgggagaaaggtcaactttcccgggaaaacttcttgcggaaacggggaggatgtgatacgctgagagcaatttcggatcaccgggaggaacacggttatgctggacatctttgatattctgggccctgtgatggtgggcccctccagctcccatacagcgggggcggtgcggatcggccgcatggccaggaccctgctgggggcggaagtggcgcgggcggacatcggcctccacggctcctttgccgataccggccgaggccacggcacggaccgggcgctggtggcgggcctcctggggatgaagccggacgatctgggcattcctcagagctttgagatcgccgccaaccaggggttggaattccacttccacacggcccgtctgcgggatgcccaccccaacacggcggtgctgacggtggagagtgccgacgggcggaagctggagctgcaggcggcctccaccggcggcggccgcatccgggtggatcggctggatggagtggaggtgagcttcaccggcatcttcaacaccctggtggtccgccaccaggacgtggccggagagctgtcccggattctcaatgagctctccgtcagcggggtgaacatcgccaacatgagcctgaaccgggaccgccggggcggcgctgccctgacggtggtggagacggaccagaagatcccggcggatgccctggagcgtatccaggcgctctacggcgtcttgggcgccacctactacgagaaggaggaagactgaaatggctctggattccatgcaggagatcttcgacaagatccaggcggggcggaagcccttctggcaggtggtgcgggatacggacgtggaggagcggcaggtgacggcggaggcctcctttgagaagatgcacgccacctggcgggccatggtggagtccgtggacacctaccgggcggaccggcgcagcgtcagcggcctggtggggggcgacgcccagaggatgtgggactacgccgcccagcaggagacgctctgcggcccctatctgcaggaggtgatcgctacggccctgtgcgtggcggagtccaacgcctgcatgcaccggatcgtggcggcacccacggcgggggcctgcggcgtgctgccggctgtgctggtgccgctgtaccgccggggcgctgtagatgaggaggccatcgtccgggcgctgtatgtggctgccggtatcggcgcggtggttggctaccgggcgtccatctccggcgcctccggcggctgccaggcggaggtaggcacggctgcggccatggcggcgggggccctggtggacctgcggggcggcgggccggagcagatcggccacgccgtggcgatggcgctgaagaacctgatgggcctggtgtgcgatccggtggcgggactggtggaggtcccctgcgtcaagcgaaacgtcatcggcgcggtgaatgccgtcagcgcggcggacatggccctggcgggcattgagagccgggtgcctgtggaccaggtgatcgactgcatgggcgacgtgggccgccggctgccggtagagctgcgggagaccgctctgggcggtctcgccgccacaccattcggacagagcgtgaaggcaaagcgggaagagcgccgctcccaggaacaggagctgtgaggacgaaagaaggacctgccctgcggcaggtccttctttttgcgaaagggaagatcaggcgttccggctggccaggactttctggaaccagtccttgccgtctacaaagcgggagaccaaaaagctcaccacatagtcgccggcggagttgatcatggtagcggggggatccaccaggtttccgatggtgatggcgatgggataggcgatggccagctggtccgggaagaacacggagcacatgatgaactcgccgatgtagccgccgccggggacgccggacatgcccacggaggacagcacggccacaatcaccatcagtgccatgtcgccgatgctgtcaaagggccggccgaacacgccgaagaggaacgtgatcttcagaatgcaagagaagcaggagccatccatgtgcatggtggcgcccagaggaaccacgatctcgctgacatccttggagataccggtggcctccgcctcttccatgttggtggggatggtggccacggaggagcaggtgcccagggaagtgatggcaggtttggcgatgtgccggaacatttccttgaccgctcccttgccgccgccgaaccaggcgaacaaggggaaggccacaaaaatataaatgaagcagaggggatagtacaccaccagagcccgggcatagtccgtagcgatctgggagccgtaggtggccaccaggttggcgaagaagccgaagaaggcgatgggggcgtagtaggtgactagctgaacgaccttcatcatagcttcggacaggctggtgaggaatcttgcaatcaggctgtcaggacccggccccagatttacgccgaagccgaacagaatggagaagacgatcaggggcagcatggcgctgcggctgagcaggccggagaagtcgctcaccgtgaagaagttcacgatcaggtccgggatggagatgggatcctccaccacgccctcagtcaggttggtccagggctccagaaccggggggaagatcttcataatgacgatcatgatgaccgcagcgatggcgccggtgatgacgaaggtcagcacggtggtgcccatgatcttgccggcccgtttgcggctcttcatggtagccacagacccggcaatggacgaaaacaccatgggcaccacgatgcagaacatcatattcaggaacagggtgcccagaggttccagcaccgtggcgccggcgctgatgacgttgccctccgcatccagctcctgggggaagatccagcccacgatggagcccaggatcatggcccccagcatgacggccagaaatgcgtagttccgggcaacagactttttgctcagctgtgtactcattctctctcctccaatacatattgaaatagctgctgacctatatggccttccggccttacattataataaggtcctcatccgtaacttcacccctgcacaccacgttggtggggcctgtcagataaaggctggcgatatgggagtggacccgctccgcatcgatcaccaagcggccgccggtcatatccacctgtacgccgtggccggagactttgccctgcagagtcagcacggtcaccacagatccggtgccagtgccgcaggcataggtgaagtcctccacgccgcgttcaaatgtccgctcgaaaatcagatcttcaccggtgatctcgtagaagttcacattggcacccttgggaaagaccttgttccagcgaatagcccggcccagctcccgcagctcgttttcgtccgcctggcgcagtccggcgtatggcaccacggcgtgggggatgccgggatttcccagctccacataggagcagacgtatgtcacgccgtctgcctccaccgggctatccagtcgtacggtggtggggtcgttcagccggatgcggtacagccgctggtcgatccgccggccggtgacgatgcctgccgtggtctccacagtctgcgtctctccggccagcccgttttcgtagccataccggcagatgcagcgggcaccgttcccacacatctcacctacgctgccatcagaattatagaacagcatccgataatctccgccctgggagggggcatccacaaccatcaacccgtccgccccgatggacatgtgccgttcacacagcgtccgggcgatttgtggcagctgctccagggggaggtgctcctccaggttgttcagaatcacaaagtcatttcccgcgccgttcattttccaaaatctcaagtttccacctccttcttgtatatacattattataacagcgagaactgagaatgaaaagcagagaatgtgcggaaaaccatgcagaacctgcgaaatccacgtcagtgggaagacggtcgaaaaaaatcgagaaaagaggaaaaaggtattgacaaaaggggaaggatttggtattctaacaaagctgtcggcgcggtgatgagccgggccgggaagaaatgaaaaaagttcttgacagcaaggctgagatgtggtaacctaaacaggttgctgctgatacgagatggatcggatgtcaaaaaacttctgaaaaaagttcttgacaaacgaaatgaaatcgagtataatagcaatgttccgccgggaacggcgtgcaccttgtaaattaaacaacgtaacgaaaaggaagcaccagaaggcgagctcatttagatgagtttgccaaaggacaaagccgtctcactgggttgagtcaattaccggtgggatggagaaatgaagctatgacaaatagctctatgaaggtttgaacggactacggttcgtttagataccattttatagagagtttgatcctggctcaggacgaacgctggcggcgtgcttaacacatgcaagtcgaacggagcacccttgactgaggtttcggccaaatgataggaatgcttagtggcggactggtgagtaacgcgtgaggaacctgccttccagagggggacaacagttggaaacgactgctaataccgcatgacgcatgaccggggcatcccgggcatgtcaaagattttatcgctggaagatggcctcgcgtctgattagctagatggtggggtaacggcccaccatggcgacgatcagtagccggactgagaggttgaccggccacattgggactgagatacggcccagactcctacgggaggcagcagtggggaatattgggcaatggacgcaagtctgacccagcaacgccgcgtgaaggaagaaggctttcgggttgtaaacttcttttgtcagggaagagtagaagacggtacctgacgaataagccacggctaactacgtgccagcagccgcggtaatacgtaggtggcaagcgttgtccggatttactgggtgtaaagggcgtgcagccgggccggcaagtcagatgtgaaatctggaggcttaacctccaaactgcatttgaaactgtaggtcttgagtaccggagaggttatcggaattccttgtgtagcggtgaaatgcgtagatataaggaagaacaccagtggcgaaggcggataactggacggcaactgacggtgaggcgcgaaagcgtggggagcaaacaggattagataccctggtagtccacgctgtaaacgatggatactaggtgtgcggggactgaccccctgcgtgccgcagttaacacaataagtatcccacctggggagtacgatcgcaaggttgaaactcaaaggaattgacgggggcccgcacaagcggtggattatgtggtttaattcgaagcaacgcgaagaaccttaccagggcttgacatcctactaacgaagtagagatacatcaggtgcccttcggggaaagtagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtaatacaatggcggtcaacagagggaggcaaagccgcgaggcagagcaaacccccaaaagccgtcccagttcggatcgcaggctgcaacccgcctgcgtgaagtcggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctggatcacctcctttctaaggagacctgggcagagcaagctctgcctggaattcctggtcagctggagcggaaaaagagttacgttgtttaatttagagggcgtacgccgggagatagaaggggatatagctcagctgggagagcgcctgccttgcaagcaggaggtcgccggttcgaacccgactatctccaccaagagaataaagcgtcacctcgtccaagacgagggcccgtagctcagctggctagagcgtacgactgataatcgtaaggtcggtggttcgagcccactcgggcccaccaggcgatttgcctttggatttgaagacctgatcgaaagatcggatcttcaaatctgactgcaaaagcggttggaagctgtgccggagacaagcgaaagcttgcggacggcgatctgcaccttgaaaactgaacaatgtgacaaaagcaagtaaggcaacagagaggtttctctgtggagacacagaggaaacaaattgattgtggaacagcatccgaaaggatgcagggtgacatacaatttcgatctttgtaaagcctgcataattctcaaagagaaccaagaattctctgacaagtcgctgtgagaacggcgataggtcaagctggaaagagcgcaaggggaatgccttggcatcaggagccgaagaaggacgtgacaagctgcgaaaagcctcggggaggagcaaatatccattgatccgggatatccgaatggggcaacccggctggacaatatccagtcatcctgcgttgaacaaaataggcgtaggaagggaaccgcctgaactgaaacatctaagtagggcgaggaagagacatcaaccgagattccgcaagtagtggcgagcgaacgcggaagaggccaaaccgagggatttattcctcggggttgcggacagtcatttagcggaagttatctaggagaagggtctgggaaggcccgccatagagggtgagagccccgtatccgaaagagaaggccgtgcgactgaatccagagtaccgcgggacacgtgaaaccccgtgggaaacaggggggaccaccctccaagcctaaatactacctgatgaccgatagaggagcagtaccgtgagggaaaggtgaaaaggaccccgggaggggagtgaaagagaacctgaaaccttgtgcttacaagctgtcaaagcacgttaacgtgtgatggcgtactttttgtagaacggtccggcgagttatagtaacgagcgagcttaaggcattcagtgccggaggcgaagcgagagcgagtctgaatagggcgtaaagttcgttgccatagacccgaaaccgggtgacctacccatgagcaggttgaagtgggggtgaaaccccatggaggaccgaaccgacccccgttgcaatggtggcggatgacttgtgggtagcggtgaaattccaatcgaactcggagatagctggttctccccgaaatagctttagggctagcgttatgttagattaccggaggtaaagcactgaatggtagcggggccgataaggttaccaacgcctatcaaactaagaatgccggctaattgatgcatagcagtcagacagtgtgagataagtttcattgtcaaaagggaaacagcccagacctacagctaaggtcccgaatagatgctaagtggaaaacgatgtggagttgcgaaaacaaccaggatgttggcttagaagcagccactcattaaaagagtgcgtaatagctcactggtcgagtgactctgcgcggaaaatgtaacggggctaagcatctaaccgaagcttaggattgtcgtaagacagtggtaggggagcgttccatgtggggtgaagtcgcagcggaagcagcggtggactgcatggaagtgagaatgccggaatgagtagcgagaattatgtgggaatcataatggccgaaaatctaaggtttcttggggaaggttcgtccgcccaaggtaagccgggagctaaggcgaggccgaaaggcgtagtcgatgcacatacggtagaaattccgtagccaccgaactttaagtcagagggacacttttggatagcggaacccgggcgttggttgacccgggcgaaagggagcgaaaatatagtagcgaagtccgcgatgctgagaggcgagaaaagctctgatggatactaaggtgcccgtaccgcaaaccgacacaggtagatgaggagagaatcctaaggccaacgggagaagggttgttaaggaactcggcaagttgaccccgtaacttcggaataaggggagcctcgcaagaggccgcagtgaaaaggcccaagcaactgtttaccaaaaacacaggtctatgctaaatcgaaagatgacgtatatgggctgacgcctgcccggtgccggaaggttaagaggagatgtcagcgcaagcgaagcattgaattgaagccccggtaaacggcggccgtaactataacggtcctaaggtagcgaaattccttgtcaggtaagttctgacccgcacgaaaggcgtaatgatttgggcactgtctcaacagcccgcccggcgaaattgtagtactggtgaagataccagttacccgcaactagacggaaagaccccatggagctttactgcagcttaatactggaattcggtaacccatgtacaggataggtgggaggcttggaagcaggggcgtcagctcttgtggagccgccggtgggataccactcttggattgctgaatttctaacctgcggccgtgaatccggtcgggggacactgttaggcgggcagtttgactggggcggtcgcctcctaaagagtaacggaggcgctcaaaggttggctcagcacggacggaaatcgtgcagtgagtgtaaacgtagaagccagcctaactgcgagaccgacgggtcgagcagtaacgaaagttggagttagtgatccggtggtatgtgagtggaaatgccatcgctcaacggataaaagctaccctggggataacaggctgatctcccccaagcgtccacagcgacggggaggtttggcacctcgatgtcggctcgtcacatcctggggctgaattcggtcccaagggttcggctgttcgccgattaaagtggcacgcgagctgggttcagaacgtcgtgagacagttcggtccctatctgttgcgggcggaagagatttgaagggagctgtccttagtacgagaggaccgggatggacgtacctctggtgcaccagttgtcctgccaagggcatagctgggtagctaagtacggacgagataaacgctgaaagcatctaagcgtgaaactccccctaagatgagatctctcacctcgaaagagggtaagggcccaggaagactacctggtagataggccggaggtggaagtgcagtaatgtatggagctgaccggtactaatagcccgagggcttgacctacgagaaagcaggcgagcctgaaagcagcgtcacattgttcggttttgagggtgcagggaagcatgctcaagggatttgcacctttagctcagttggtagagcaactgactcttaatcagtgggtccccggttcgagtccgtgaaggtgcaccatggcccgttggtcaagtggttaagacagcggcctctcacgccgttaacatcggttcgaatccggtacgggtcaccagacttttcaagggcgaaagttcttgacaagggaagcgaaatacaatataatacagtttgttctccggcaagaccggatgacatagagttggtgctgattagggcgagggtccacccgttcccattccgaacacggcagttaagctcgttcctgctgacaatacttggctggcgacggcccgggaagataggtagcgccaacactgagaggccacatcgtttgatgtggccttttttcgtcgcatgggaggcatcgttttgcaatatcatcaagtggtcaaaggaagatttctacggcggcccaaccgttttatcgctcatgtggagacagaagacgggctgcagatctgccatgtaaaaaacaccggacgctgccgggagttgctggtgccgggagcagcggtctatctggaaaaggccgcaaattctgcgagaaagacagcgtatgaccttatcgccgtggagaaaggggccttgctgatcaatatggatgcgcaggccccaaatcgtgtttttcaggagtgggccgcccaaggacatttcctgccagatctaaagtccattcaaccggaatatcattatggagagtcccgtctggactttgcgctgacaacagaagccgggctgcacctggtggaagtcaagggtgttaccctggaggaaaacggtgttgtccgatttccggacgcgccgacagaacggggcgtgaagcatattcacgagttacagcgggctgtccgggagggaatgggcgctaccctgttttttgtgatccagatgcacggcgtggatcgcttctctcccaacgacgccacccatccggccttcggtgcggcccttcgggaggcagctgcctggggtgtccaagtgtacgcctatgactgcctggtgacgccggacagtttaactatccaccagccggtgccggtggtattataagggagcggcaatatgggatttttggaattgctgttgatcggcgtggggctctcgatggacgcctttgctgtagcggtgtgccagggactctgtatgccaaaactgaatctgcgctatgcggctgtgattgcgctgttttttggcggatttcaggcgctgatgccctatgccggctggctgctgggcgcccaatttgccgggtacatccaacatctggaccactggctggctttttttctgctggcattcatcggcggtaagatggtgtgggagtctttgaaaggggaggcggaggagacggcctgtgcggtgagtgtgacgctggattataagcagctgctgctgatggcggtggctaccagcatcgacgcattggctgttggggtcacgtttgcatttttgaacgtggacatcctgcctgctgtgacggtcatcggctgcacgacttttgtgatctccctggcgggtgtggtgatcgggacctttttcggcgcccgcctccagtgctgggcggagatcgccggcggtgtgatcctgatccttctgggtggaaagattcttctggagcacctggggatcctgtaagcgcctataaaaaacagcgaagtggaaaacgccccgggccatttggcccggggcgctggttatcttatgaaatctcagcagcagggattgggattgcagccgcagttgttgttgcagccacagccgcagccgttgccgccccagctgccgttgccgcagcagcaccaaatgatgatcagcagaatgatgatccagcagcagttgccgccgccaaagccgttattgcacataccggaacctcctatgaaatcgtagaccgaccgaaccggtctcaatccatagtatgccggaccggcaaaggggttccggttttatttccggccgctggtgacgagtgcgtcggccgcctgtttctcccgcacggtgaagacgcccttgtccatcagcgtgtctcccagtgtctgcctgctgccggacaccgcggcatccagcgcgtagtaggagacgtatgcgagatccgcacggaggaacgtgccgccctgcagggcggccagctcgccctccgtgatgacgccattggtcaaggcattggtcagtgtgccggagaggtccttgttgtccgcggagctgtatcccagtgcccggaggatgaactccatgtattggctggctgtcaccgtctggctgggccggaaggtggtggcggagtatccgttggtgtagcccttgctgtatgcgtagcccacgtatttctcgctctgggtcccggaggtgatgtccgtgaagggagtggagccggtgtaggccagcgcatcattctcctcgcccaggacgcggatgaacatgatgagggcttgcaggcgggtaggggcgacctccaggtcatatccatctccgtagccggtgaagctgccttgaaacaggtgcatggtcttgagcgcgacagcaatggcgttgtagtccgtgttggtggagtagctgaaggcgtaggggccctgataatccacaaccgccgtcttggaggtgacggtaaacacggcggtggtttcctcagccaccagataccggtggctggctgtaagggcactgccactggtaacgatggtccctgtggtgacatccaccacagcgccggagttgaacgtgacctgcataccgcccgccagcaacaggacgcccgtgccggtggagccggtcagggcgtcgcctgccttcagacgggtctccatccacgtggcggccccgccgtcggaaggagccgcgtctccgttcagcagcgcttggtcagaggcgtccagtttttcctccacccgctggtctaccgcatcggtgaaagtgccggtgagataggagagggaggccagcggatcggaggccccgccggccgcggccaaggcgtacacaacggtgacggtaagtaagaggcagacggtgatgagggcagtcttggtcttccttgtcatagatgattcccttccacgctggagcgtcagcggttggcgatgcggtaactgagggtcaggaggctgtctgcgaagtgaatgttctcaaactgcacatccgggagctgactgctgagctcaatgttggtaaagttccaaaagcccttgacgcccagattgatgaggtggctggcggtgtcctgggccacggactggggaatggtcagcaccaccacgtccaccgggtggtcctgtaggaagtgatctagctcggacatggcgtataccggcacattattcaccacagtcccgatcacggcgggggagacatcaaaggctgcgtccaccgtaaacccactctgggagaatgggaagttctgcagcagtgcgtggcccagattgccaacgccgatcatgatgaggtggtggttgttgtccacgcccaggatatgaccgatctcggcccgcagttcttctacattgtagccgtagccctgctggccgaactcaccgaaacagctgaaatcctggcggatctgagaggcggtgatgttcatctcctgccccagggagtgtgaggagatgcgcacgacgccgcggttgcagaggtctgtgagctggcggtaatatctgggcagacgccgtatcacggcgtcggagatgttttcctttcgcatataagtcactccttgctatttgttaaatcattctcaattaagtttagaccaaaatcagggacttgtcaatttttttaacaatctttttgagaaaaattttttcaagaaaagctttacaaagcggaaaaatgttggtatactaaataagctgtttgaagaagatgttgatgtatgcgcctgtagcgcagttggatagcgcgtcagactccgacatttcaggctcgttcagttgagagatggcgcaaagcgttgggagtctttggttttaacgggcagagagaaaaaattctgtttccgttgactactatttgactaccaattttgaaaatcccgtgttataatagaacatagtttaggtatgcgcccgtggcgcagttggatagcgcgtcagactccgactctgaaggccgctggttcgaatccagtcgggcgtaccacgtgcaaagaggcactcgaatttcgagtgcctctttgcttttatcaatcagaggtgatgaactatggagaaacccatcatcggggtaacgcccctgtgggacgaggaaaagaagtcctactggatgctgccggggtatctggaaggagtgaaggaagccggtgccatccccgtcatcctgccgctgacaaccaatggggcggatattgcccagctcgcggatctctgcgatggttttctctttactggtgggcaggatgtcgatccccagctgtacggggaggccatggagcccttctgcggcgagctgtgccctgcccgggacgctctggagcaggagttactccgacaggctttggagcgggacaagcccatcctgggcatctgccggggtattcagttcctaaatgcagccttgggcggaaccctttatcaggacctgcccacggagcacccgtcagagatcgggcattccatgaagccgccctacgaccggatggcccacacggtgcatatatggccgatgacgcctctggcctctctgctgggaaagacggaactggaggtgaacagctgtcaccaccaggcgatcaggagtttagcccccagtctcgtagaaatggcccgcagcacagatgacctcatcgaggcgatgtatctgcccggcaagacctttgtctggggcgtccagtggcatccggagatgtccctgcaggaagagtccagcaggaaaatttttgaggcgtttgtcggggctgtccaacaaaaatgagctgccatcgaagaattaccccccgtccaaaggacgggggatttctttctgttgccgctttcactcagccagaggaaacctccgcggctccgccacacactggtacagcacagcgtcgcagttccggtaaatgatatacttcagccggttgctcgggggtccattccgccggaaggtcacgatggcctcgttctgttgccagccgatccccaggttatacgatccgcaccaggcgcagtggttgacggggatctgcggctgtttcgtttctctgtatttcatcaaatctccagtccctcctgcagaacctgactggccgctttcttgttcttattaaatgcgtgtgtgtagatgtccagcgtagtggagggctgactgtggcgcccagcagtcccgccactgtggctacgtcggccccgcccgcgatcaggaggctggcgttggtgtgccgcagggagtggacgttcagggcagggggcaggccgtgcttctttaagatcagcttgaaccgccaggcgaaggtggagggcgtcatggggagccggtctccgtgacggcggaagatatagtccgtatcctctaattcccgcccatcatacgtttccgtctcccaggcgcactcccgctggaactcctgcagcagggacaccatctccagagagaagtaaacataccggcctccggccacagtctttgtctccttggcgatgatatcctcgccggtgacctttaccacattctgctggatgtgaatggaccgctcatcccagttgatgtcgccccactgcaacccgcagcattcgccccggcgcatcccggtggcgatgatgagcttgaagtaggtctcgtacttgaggttcccctcctccagtacggcaatgagctgctgggcggtggcctcgccagcgatcaccttctctttctttttcccggtatagtggtatgtccgccaagccggggtatggtccagaaagccgccctccatggcatctgagaggatcgtacacagcgttgcgtgtacaccctccacagtgcactcggagagcggctttcacgttctttgattcttcactttccgaagaccggagtggagctgccggaaatactccggccgaagttccgtcagcttgtagtgccctaggactggcaggaagcaatcaatgtcctgccggtccctggccggggtaggcttggtcagcttgccgggagcgatctcacggagccacagctccgtgtacttcgccagtgtaatactccactccacttcttcctgaggaagcgacctgcaacacttgacaaaaactgccgaaagcatattgctttcataaacgtcaaatacgggaggatataaaagatttcattgatctggcgagccggttgaaccgagctgtgtgagcctgaccactatttgcaaaaaggcccggagccattgcatcgcaatggctccgggcctttttgcaaatgacgagaaacttgtacaaattcactgaaatccttgcattgcggaggctttcttgcttttaacgcttatcagtattttgacagagaattggcttttgaccagttccagcgttcaacggaatttgcggagaacgctgtcgcaagatcgtcccaatatatggagtaatagacaagatgttgttaaatggtatcaaaataatccgtggatccgggttgcccatcagaggtcagcaaaagcaggcaaccaaaaaaattctgaaaattatggtaaggagaatcaaacacaccgccgaacctttcacgcattttttcaatccggtacacgactgtatttcgatgtacatgcagttcctgggccgtcaaagccaagctctgtccgtttttcagatagataaacaatgtttttacatagtcggactgattgtctatatcgtatgccatcagattacgcaaaaaagcactgacatagtccgtccgctgttctgcggggatcgaggcagcaagccgccaaagcctgtagtcatcatattgggcgatcctggcatcactcccggagatcctggccattttttctgccatggcagcctgattaaagtaacgccggatctcatacaggtctgagaatgtatcactgataccggcgcacagatcatgctctgacaggtatccctccaactgctgcaatccgtcctgcggaatttgcctgctttttccgcactccaccagtaagaccacatattctcggaaaaacagggaccacgcctttggaaagatcgttcccaaacgtgccttgaaatgccgctctccggagactcgagaagaaaacgcgtgcatattgataccgatcagggaataaggaccggcctgctcgaaaactgttcccaaaattctctggagaaaaagcgcacgattggcaaagccttcattcagtatgctggatagcagcatttctgcggagtcatgctggtggctaagcctgattgcctgttcgatggtaagctcctttaccaaaacgcctgccacgagatcgtagatctccccagggaccgcatcaaaagcggtatggtattccagcacggaaagatacccgatggtcagagagttggagatcagaggacatattcgcctccgatggggcccccagtcatcaaagatttgaaagggcagcggagttccccgcatactctccaccccatggagcatagccgcatattcaaaaagacagtatcctcgcttctttccggcagtccacacctcatcctgaacatcagtggtatcagaatatgataccgtgtagtagttcttgtcaaacactgcaatgggatttttcagcacctccgctgcccgatctaccagcagatccatattgttgtaatgaaatgaaaagctcagaaattcttggatcgtctcatagtcaattttgcacattttgcacagtttcacctttcctctgtagaatgggtttattctatgagtacaaatccagccatcaaattgataccattgtaacattgagtcccttttttcgcaatgctaaattatttacagaggatactaatttgagaggtcctaacaaaaccagccatcaaaaaatgacattaagagggagggattttttcaaatgcggacaattcgcatcggttctggcgcaggcttcagcaatgatcgggtagaacccggaattgaattgcttgagaagggacagctggactatttctgcttggagtgtctggcagaacggaccatagccattgcacaaaaggagaaaaatctagaccccaacattggttacaatccttatctcgcatatcgtatgaagaagatcctgcctatcgccgcggaaaaacatgtgaaagtcattaccaacatgggtggcgcaaatgttcagaaagctgttgaaaaaaccgcagagattgccagaagtgcaggaatctccggcctaaaaattgtaggtgtgctgggagatgacatttttgaccgtttggaccggtacgcggactaccccatttttgaaactggtgagcggcttggcgatttgaagaacaaagtggccgccaacgcctatctgggctgcgccggcatcgtgcaggctcttaaggacggtgcagatatcgtcatcacaggccgctgctccgatcccgcgctgtttctcgggccgctggtatacgagttcaactggcccatggataactatgatctgatgggcaaggggactgttgtgggacatcttctggagtgctccggacaggtcagcggcggtaacttctgcgtgcccggatataaggatgtagaagatctgtggcatctggggtttccctatgcggatgtcagtgaggacggcaccatcgagatctccaagttggaggggaccggcggacgcgtagacgtgcagacctgctcagagcaactgatttacgagatccacgatccctccagctactatacgccagactgtgtggcggacttctcccaagtcgcctttgaacaggtcggaaaggaccgtgttcgggtaacaggcgctaccggccgcccccggaccgacacgctgaaagtcagtgtgggatacaaagacgggtacatcgggagctgcggactgagcttcggaggccccaagtgttttgaacggatggtactggctgttcagaccatggagaagatcattgagacctactaccatcctgcagagcaccgggtggatattatcggctacaactccctgtatccccgggacctgtcggaggggttccccggcggagccgagccgctggagctgcggatgcgggttgccgtacgcgatgccgaaaaagagatgctcaccatgatcttcaatgaggtggatgcctttactattgacggccccgccaactgcggcggtatggaacgccatatcacggagctggtcgcggtgttgtctgtcctggtgcctcgtgaagatatcgagatctcttatgtggaggaggttttgtaagatgaagctgctggaaatcgcacactcccgaaccggcgataaaggcgatatctccaatatttctgtcatcgcctacgatatgaaggattacgagttcatcaaagaaaaagtcacggttgagctggtagccaaggtatttgccggatactgccgcgggacagtcacccggtatgagctacccaagatcggcgcgctgaatttcgtcctgaccaaaaccctgggtggcggtgtgacccgcagcctgcggctggatacccacgggaagtgcctttgctcctatttgctggatgtggaactggataacgtgtgaatggagggccagctatgaacaaaccaacctataccatcaaaccgctgtacctgggcgagatgaccaggtatgaaaaatccatgcacacattcacctttgactatggtgtcaagatgcactctccctatctggcctttttggtacagggtgatgggaagaacattctggtggacaccggccccaaaaatctggaggtcattaaaagatatcacagccatgtggaggcagacgtgcccccagaggttcacctgctcaaggtcttggaaaagcacggactgaaaccggaagatattgacttcatcatctgcacgcatctgcattgggaccactgccagaacaatgactgcttccccagcaaaaaagtctatacccagaagcgggaagtcctgtatgccatcaatcctgtggaactacactggtatacctacgagtctccgcagtgcggattgacacctgtctgggcttctgccggcacgaagctggttgtcctggacggcgatgaagagattattcccggcatcgaagtgttcttgactcccggacacactcccggttctcagtgcgtacgtgtcaacacagaggatggctattatctcattgccggcgacacagtcaatatttatgaaaactgggaaggcaatgccaaataccaccatgtgcctgcaggtatccatgtagacctgagagagtatgaagagaccttcaaaaagatggataagatcgatttcaaggtcatccttccaggtcatgatatgaaggtgctggagcacagcgtatatccctactgaggaggagaaccatatgcttacaacctacaagatttttcccatatatctgggggaaattccagtacatgataagtccagctttacttatatggtggatcccggcgtcaaaatgacttgtccattcatctcctttttgcttctgggcagcaacggtagaaaaatcctggtggacaccggcccctgcgatgccgaatggggtgccaagtatcatatgcccctaaatattccggacgggtgtgagatcgtggaggttctgaggagagactttgaccttgcgccgggggatttggactatatcatcaacacccatctccactgggaccacagctgcggcaaccacaagtttcctggcaaaaagatctatgtacaggcatcggaattggaatatgcactggatccactgcccatccaccgtgccacctacgaatctccgcaatacggtgtggtgtctagctggatgcgagctagggatcagctggtcaccgtggacggagatactgagattgatgacggcatccgcctgattttgctacccggtcattctgacggtatccagggtgtactggtctccacggagaacggcccgtatctgctggcaggcgactgcatcaacctgtatcagaactgggagggcaacggaaagctccggcacatcatcggcgggctgcattccgatgtaaaagcatatttcaagacctatgagaaaatagaggcgctggaacagacagaacatatcaagatcatccctggtcacgatgtacacgtactggatcacaaagtctatcctgtatccgtcgaggagggttctgaatgaatatcctgtttttattattggccattgcactgttcattgcgctggttctgaaaaatgttcccatcgtcatcgccacgatcctgtcctctatctttctcttgctgacacagcagatggacttgtatgatggaattaccgccacatacatgacaggctttggagactacgtaagagatttcttcctattatttatgctgggtgcactctttggaaagctggtggagatcagcggcgcggccaacagcatctctacatttatcttccgagcctttggagatcgctttgcaatcatcggcctgatcatcatgggcattatcttaacattgggcggggtcaacctgtttgtggccatgtttaccatgtaccccctggccatggctatgttccgcagggcagacatcccccgcaagttctttgctgccgcttattttgtgggctgtgtcggtgcgacgatgaccgcgcccttcacaccgtctatccagaacgcgacacccactgtctatcttggcaccacagtggccgccgccgctgttccgggcatgatctctactgtgttgaagctggtgttttgcactgcttatgtgatgtgggtcgtcaaacgggccaagaatcgcggggaacactttgaagagctggagggagaggctcccgccactgaggtgggtaaggaaagctctggcccctccgtgctggcatctgtgctgcccatgctggtgatcctgctggtgctgaatgtggccaagcagcccattgtcacctccttgctggctggtattgtggcagcatttgtgttctacttcaagcatatgccccacagcctgaaggagatcagcgccgaggtgcaggacagtgtgttctctgggctgaagacgatttccattactgccgccgcagcgggctacggtgctgtggtcgccgcgacaccggctttccaggaaattacagactttgtcctcaatctggacggcaatcccctgctgatcgccggcattgccaccatgctgatggcgggagttatgaactcctcctccggcagtatggccattgtctgtcccatcctgggtgagaggttcctggccatgggtgtcaacgccgaggcgctgcaccgggtgatcgtggttgcatccagcactctggattccactccgcaaagcggctttgtgtgcaatatcctcaaccacagccacaccactcatcgacagggctactggcacgtctgcgtggtgtccgtcattgcgcctattgttgaaacattgctgctgatccctctatgtgcaatgttcggcctggcataacaaaaaattgcggcctggaatatccaggccgcaacacatatcacaagaggtacaatatgataagaaaagaaatcattggtgtttacggaacgggtaccattggctccggtcaggctaccttgactacaggtaatgggtatgcagttgtggtagttggacactccgccagaggaatcagccgctgcaaacgcgcaattgagcataactgggatgatcttattgccgagggtctagcgtccgaagaaaataaggcggcagcaatgaatctgctgatcttttccgatgaattggaggcgctgaaggactgcacctttattctggaagcggtatcggaagacccggatgtcaagcgggaggtctatgctaagattgcctccatctgcaggccggatactatttttgcatcgtgtacgtcttccatggacgcggaccaactcgcagctgatattcccaatcccgaccgctttctgattgcccacccatttcagccggttcatctgcagccgctggtggaattggtgggatgcaaggcaacgagcccctctacgctgcggcgggccaaggcgttgatggactctctgcaccggcagacaataatcctcaaccacagcgttcccgggttcatagtcaatcggctggctcaggctctgtatagggaatgcattgacctcattgagcggggagttgcggaaccagccgatatcgacagagctgtacgttacgccgtgggtatgcggtatgcatccattggcctgctggaatatttcgatgccgtcggatatgaattggaggcagccatcgccggaaatatctatcccacattgtgcaatgcgagatctgtgcagcaacttgtggcagatggaattgctttcggaaaaactgggcaaaaagcccgacagggtctgtacatctggtcggagtctgatctggaagattttcgtgatcgcctgcaacgcccgtttttcacccaggtaagagaatgggagctcccaactggcacttctgaccagtaaatcgtacagtgtcatacgaagaccactatccggaaaacacccggagtcattgtgttgcaacggctctgggtatttttggaaatttggcaattttcctaaaaaatggccaaaacccacaaaatacctagggcccaacgacttcctgcttgatcgcttgataaccccatctctgtaggctattgacccaaatttggctaagcgtaccaaaaccgccgaaagcaatttgctttcggcggtttttacgttatagaagtttcatattttgcggtagggcgttggtacttctacagccctctattccgccggaggaaacctccacggctccgccacatactggtacagaaccgcaccgcagttccggcagatcacatacttcagccggttgcccaggagtccgttccgccggaaggtcacgatggcctcattttgctgccagccgatccccaggtcatacgatccgcaccaggcgcaatggttgacgggaatctgcggctgtttttcctctctgtagatcattatatctccaacccctcctgcagcacctgactggctgcctttttgttcttatcgaaagcgtgtgtatagatgtccagcgtggtggacggctgactgtggcccagcaggcccgctacggtggccacgtcggccccgccggcgatcagcagactggcgttggtgtggcgcagggagtggacattcagggcagagggcagaccatgcttcttcagaatcagcttgaaccgccaggtgaaagtggagggcgtcatggggagccgctctccatggcggcggaagatgtagtctgaagtctccaattccctcccatcatacgtctccgtttcccaggcacactcccgctggaactctttcagcagggactccatctccagtgagaagtacacgtatcggtccccggccacagtctttgtttccttgacgataatgtcctcgccggtgacctttaccacattccgctggatgtggatggaccgctcgtgccagttgatgtcaccccactgcaggccacagcactcgccacgacgcatcccggttgcgatgatgagtttgaagtaggtctcgtacttgagactctcttcctccagggcggagatgatcctttgcagggtttccagatctgcgatcttcttttccgttttcctccccgcatagcggtatgtccgccaggcggggttgtgattcagaaagccgccctccatggcatcggagaggatcgtacacagcgttgcgtgtacgccctccacggtatgctcggagagcggccttccagtttcaaggctgatgacctttcgcagatccgcatagaagttacggaagtgctcggggcggagttctgccaacttgtagtgccccagaatcggcaggaagcggtcaatgtcctgccggtcacgggccagggtggacttggccaacttgccgggggcgatctcccggagccacagctccgtgtacttcgccagtgtgatgctccgatccacttcctcctggggaagtgacctgcactcccgctcgaacaggaccgcctgctccttcaaccatttttcccgctgttttggggtcagaccctccggtggatgaacggttttctgcttgggcctgatgcgattgccctcgtagtcatagcccatagagaccaccagcaggtagctgctgccccgttttcggatacttgccatgttgtgttgacctctctttcgctggcctcactccagttgaggccggttttgcaaacacaacataccgcaagtggggaagtaaagctattgaaacttcctggaaagaacattttctacgaaagcaacaatcaggcgctgcgggatttggcgggacacgcggcggccagattgaacaggacttcgccctccgggcggagcatggcgcgcatggccccggcggcctgctctttctgctcctgctgcggatggcagtaggtgcgctccagaaagcccgtgtccgcgtgccctaccagatccgccactgtctgcttgtccacgccggagtggagcagggaggtcacatagtaatggcgaagcgtgtgcaggtgatattcctttggaaatccaatggactcatagattttccgcagccgtttggtgaaggtatccgggtgaatgagctgcccgagggcatccgtgaagagatagggaccaagttcccgatgcgccagccgggcttccagctgtttccgccggcggtagctcaaaaagattcctcggatatcagatgagagaacgatctcacggttgcggccgttcttagtagagccttccacgacaccttttccagggacaacgctgcgggagcggctgatggtcaggagcagaccgcctctgctgaacttgaaatcctcccacttgagggcgcacagctccccccggcggcagccggtacacatggagagcagatagaacatccggtagtgccgaggctcctttgccagagcatccagcagtttctgaatctccacgggggagggaatgtactgtgtagtgcggcgtgttagaggcagatcgatcatccgggccgggttcttctggatgatctcattccgcttggcgtcgctaaggacagcggagaccacagtcaggtatttctgcaccgtggcctccccaatgggcttgccacggtatttccgcttccgcagttctaccagcatattctccagagcaatcggccgtagccggttcaactggatggccccgataaagggatacacccttccaagcatccgccgatagctctccaacgtgctgggggcataccggacctgccgggctagccaccgttcggcgtactcctgaaagggcagattcccgtcctcgctgtaaccagatttgaactgccgttacagttcttccgcctcgtgagccacatactgccggatatcgcgcttgggaatgctctccggcacccggatagtcttggccctgcagatgtagataatcttctctcggattcggaactcacgttccatgatctctttcgtgtatttcaattcgtggagccggtcgtcccggcacttcatgccctggggtgtggtgtaggtaatggacttccgagtggccgaccatcgaacttgatacccctcgctctccatcagggagatgaagtcttccctggtagatgcgaaccgcatacattggtcgatggcattcatgagtcggaatttccagctctcgcccttggcggcagagcgatactcccgggtgtccatccacttctgctggacctgcttctgcggaggtggaaggatcgacagatggtgggcggcgcagatctcatcgttggccagccgatgggcctgcaggtcggcggcactctggtggagcttgcggccgttctggaagctgacactgtttacgatcaggtggctgtacagaatgtcggtgtcgatgtgagtcgccaccagcacctcgaagtctggaaacttccgctgggccaactccaagccaatagcatgtgcctcctggggcgtcaggccatccgttgccgcaaagaattggacgaagtggtagtactgccagccatctgttttaacgaaccgctccttggtgagctgtatctcctgccacgccgtcggggcagtacagttccagcctgacaccagccgatgtccttcccacagcgttttttcgtcctgtcggatgtactgaagcactccggcgagcgcgccccggccaccgccccggttcttgatggtggtgaaggtagccatctcagttcacctcccgcagcagatggcagagctgcccacagatcgcttcgtacttgtccgctaaggcgtcgccgcgcagaatcgtgaccttgcccatgttggccagggtggtgagctggttcaggttccgcccctgagccttcagctcggagagcaccttgtccagcccctccacctgcacgatctccttacccaggccgcagaggcacaggcaatcggtgacggttttgtttacgcttttcgcacgcgcctggatgacggcctttgtccgggggcgtcactcggagcgtgatgatttccgttttcttttctctcggcattcgtactcctttcaaactttcgccccaaccaaacgaaagtccagcgaagcgggtttcgtttggagaggagacacagcggaatgaatgcgccctgccgctcgcggcggggcaaatgatatggagcttgtgtcgacgaaggggctgggggcggggcagggccccgaaactgcggccggtgtatagccccggacgcgatgcttgccctcccatatgggaggtttttccctgccggagctgtgaacaccacacccagcaaattattcatatgggtcgatggtgacgatcttttcggtagcgagatcatcgacaccatcgacacttttcaggcagatgagtctgcctctgctccacctgcgaaatgacacgacgatgccactgttccttagagccccaatgtttttccaaatttgatgggagaggctgttgcgtgttagcccttcgaggtcggcaggatcaatcttttccagcagcgccttggcagagacacagatctccgattgttcccatagcaaggcggagagaagaaagacaatccgactattggacggttccgcttccgctcagttgtccctgagcagattccagatgtgacttttaccatcgaactccaggaatagctcccggtagatgatgtcccggccggtacagtagagggtggcggcgttctctccccgcctgcgcttgcggagcacgaagttggagcctgtggcgccactcaagcctgtgatgccggagatcatgtccatagggtcgtcatcattcagcttccgcaggtgatggatcaacaagacggcaatgtagtgccggtctgccagatctttgaggacaccgatgtcctggtagtagggatttgttttgttcccagccgcgcgaatgcgctggagggtatcgatgactaccagaccaatagccggatgcactttgagaaactacgcgatctgttccaccagtccgctgtggagctgctccgccatcatggcgaagtgcagcgacggaggcgtgagatcaaagagcaagctctggatacgctggaagctgtcttccaggtagaggtagagacttcgcacgggtatatagcgaagctccagagcgatttgccctgtgcggcacagagacatatctacagggccagccgggacttgccgatcttcggtgctcctgccagcaggtggagcccctggggcagcaggtctcctccacgacgaaccagaggggcatggggaatgatctgctgggtatctgcattaatggtattcaattttttcatccgaaaatctccctttccccaaaataaaggcgcggatcgacggccatcgatccacgccctctacaccagagaaaatgtcttgagtctgaacaaccctgggaatatccccctgggagaattgatagcagaggcactgaacatctctccggaggagtaccatgagctgcagcagatgctggatagggcaatgacagcatggaccgctatgaggaagatcactggatacgggattggttcgatgccaacgaggagatgatcctgctccatgacgccctgtgctgccgccagatatttcgactgatccaagagaaggatgagatcctatcagaagcgagaacattcccggagcagaattctcttttcccagaagaagatctggaactcggagaacgggacagagagggcctggccgcaatcggagcatataaagactacttggagtacccagaggactatggtggggaagatcacatcgtctatcaatttggcgatgagtattatacttcgtctgttcctcgaacgccgataccgccggagtcaccggaaaagacgagggcgctgttggttgcctatgggcagctgaacgtgaagtgggccgcctataaaaaatattatatataactacaaaagactcctggaagacatcgcgtcggtctgtcagacacttcgggcgttcgttcgtatgggattctcgtcgctggaaaagctgacgcccaataactatgtggcatcactgcatgaatttttgtttcatgagcgagcccataagtgggttacaaatcccgcggaagggaccggattttacacctacatggatgacgtgcggattcatcttcgcctccaggaaacggctcctggctccggcgcattcaaagtctacgagtactagttggcagacctcctccagaccatgatgaagctggatttctataaggcactggaggccgggcacctaatccgcaggtgtgagaacggtggacggtattttctgctgtaaaaaggttaccacatcagatattgcgacctgcccaactccaccaaccccaagtacacctgcgcccagctgggctaccggatcagaggcgtcaaggaggaggcggaggacagttcgctgtcccaggatctttaccactgctatcagcggatcgacaagggttggtcccgaggtgccattacagcggaggagcgaaagctgctgcgagagaaagcacaagagatttaccgcgtagcaagaacaaaaccgagtatgttctatgaggcatttaacacatctctgtctaataagaaactgtatccgctctgtgccgttcagtgaaaaagcagatccagaggaagaaaaagaacgttgatctttcatcttggaaggaagtgggcggtggcctgtgacaaacgaggaactgtatcagaaatgtcggatcggtgactccaccgcctttgaatagctccacagacagatggaaaacttcatccgaagaattgctctggatgcggctaggcattttgaatgtacagacactgcagcgacattgctgatagaagctctatgtgccgaaggaaacctggagttgtgggattggattcaggtcggcagccatgatgagcatgcgggaaattaaccacctatctcaaccccttttgcggggaagaatgtactgctatctgaagactaatttgggcgtcatagctttgagcaaggatgagatggaacgtgtacgactaccccagaaactctgccatgcggagggaaaggccatcggcgagatcgcgacactgttatatatctccgggatgtcagccgcaagactggtcggataccatatccatttcctatctgtatttgatttgtagagggaaggcgaggagggtgatccatttgagtaactagaggagcatgagcaaggaacgtctgtggagcagatcgtctaccaaaaggtgcacctggaactgctggagctactgctctgcttgctaagcgtcaaaaaccgctctattctgggccacaccttcgggggtatacggctatgaacagctatctgctgatgaaaactgggcctgcaggagatgctctcctccgataacatgacaaaggcgagaaagacagtcttggggcacctgcgccaacgctgtcccggaagtgatctccaccgctggcgcagggccttccggctgatgaggaatgcgagggcaggagattccactgcctgtctatcctatccggtgtggtgggggaaataatccatccgtgaagatgattcggaaaccttcttgccgactcccacagccgtccgcatcggtcttgggattgaagttactgttgccgtcgtagacacacaggtagggatactgacaataagggagaggtggagccacgcggctccgcatccttttatatttagctttttttgttaagcaccatctgattttgttgtagatcggccatccggagaagcagggcatgacgttccatgggctggccatctggatgaactacaacggccccagtggagtggaaagggcattcaagcgtgttatcccaaaactgaaacaacacgtccacggcggagtgtggccggacatccagagacctctccagaaggcacagcaggagttctgttactgcacgccacaagagacatggatcaaataacagtggaatctcgatataagagtcaaggtctagttgttttgcacggaagtcaatcctagagactgccttggtacatttgtggaaaaactttgagccgagcaggcattggcagagagacgttggcgccattggtattgtgtattatataggacggttgcgctctgctccatgtaatttgtccggtgttttatggctgtgggacaggtgcttcatcatcttcaggcgatcctatttttttgcgggggtgtaaacaagaactctacatggttatcagaataggcagcataggtgtggtcctgcttggggagcccttgcagcattgtcatttattgtaaacaatggattgtaaaatttgtgcgttgatgttaaaatataactaacacattggtgagaacaatacactttttgttcaaatatgcagcggctggcgatatttctttgcggtcagtagatgaatcaagtgttttgctgtggagcaccaaagtgaaactacaggccaatttggcatgggattatcagaaaggagagaaaacggaatggagtccatgaatgaggagaaagaactgttggaacacgtgatgaagctgatggcagagcatttcgggaaaaattgcgagatcgtgcttcatgattttatggcgcctgacaaccatacaatcatcggaattgaaaatggggaggtaacgggccgggagattggcggatgcgttacgaatctgggcttggagatcctcaacggaaaaccggcggaggatgcattcaattatgccacctatgctgaaaatgggcatcttctgcggtcttcctccatctattttcacaacagcgctggacagcccatcggttccctgtgcatcaacacggatattacggataccacgtattttgaaaagatgctgcgggaatacaacaatacccacgactatgaaaacagggaagatgcttctccgaaggaggtcttcatgccggacgtccatgagctgctgaatcgcctgatcgaccagtgcatccaaaaatatggaaagcctccgaagctcctgaccaaagaggaaaaaattcagtttatcgcggatctggatatgaagggggcctttgtgatcacgaaggccagcgatcgcgtctactcgctgcttgggatttcccgatacacattctatacatatctggagcaggggaggaaaatgcgtggggaaagccggactcctgtagaataaaatgtttgtctaaaagacacattttttgtcttgacatagaacggattattgtgttaaaatacaatcaaacttaaaacgcagaaataagaacaacggtagagacgaatccgatcatgttttcctctcaaaattgagagtttatttctgcgaatttttttaccctttgacaaaacagaatgtctgtataaaaaacataaagtatgtctgctatcagaggccaacttctgaagcatataaaaactgacagggggaaaaacgatgaaaaaatggtttgctctcgctcttgcggcaatgatgatgctcgcaacactgactggatgcggcggtaccgaaagcggaggcacccagcagacccaggaaacagaccagggtcaaagctcctctgagaccgacaccgtagtttacccggagattcctgcgaagaccggcagtctgaccattggtatttcgacaaacgcgctctccaatatccacaaccggcatatgtttgagggactgagagaagaggcggaggggcgcggccatactgtcgtcacggcaaacgccaatggtgaccccacgcaacaggccaacgacattgaaaatctggtgcaggccggatgcgatgtcatcgtcgttcagaacgcggacaacttctctctgaagaatgcggttcaggaggccagaatggcaggcatccgcgtgatctgcgaagacaccggctggattgacggcatcgacgccatgttcctgctgaacagcattgctgtccaggcagacattaacatgatcctggcggctgaggtgggcttcagcggcaagatcatcacaacggggcatcaggacaactttgctttgagggctggctcctacatccatgacgcatttgtagaagaatatggatttgatgttgtagctcatgtacagacaaccttccctggtacgaccgaagtgacttataacggcgtagactctgcgctgacagccaaccccgatgtggttgcgatcttcacatctcaggatctggaggccatgggtgcgatccaggctttgaaggagcacgatctctatcctcaggtaaagtgcataggcgttgacggcgaggtagacatcctcaatgatatcaaggccgacggctcctgcattgccacggtggtgtccgatctggacagcgccaatgtcaatgtcgtagatgcctgtgaggcgttgatggccggcgaggatgtggcgaagtaccacgaaatcccgtacgccgtcgtcacaaaagaaaatgtggatgagttcctggagaaggctactgctgaggctgagaagtacgcggaataaggctgatatagagaacattgggccgccctgcgctccggaatggggcggcccgatgccatctatgaaatatttttagaaaatgaaggggaactgaccaatgagcgtgtatgagaatttgaaagaacatgggatcgagctgcccaagcagctggctgcggccggactctataagcctgtgaatcaggccgggaatctggtgttcatctccggccagggcagcatggtggatgatacgaagatcaccggccgtgtgggcgctgacctgagcgtggaagagggcgccgcagctgcgcggatctgcgcgatcaacacactggccgcgctggaggcctatctgggggatctgaacagggtgaagcggtgcgtgaaaatcctgggtttcgtggccagcacagatgatttccatgagcaggcgcaggtcatcaacagcgcgtctcaggtctttatagacgcctttggagaagaggggcggcacgccagatccgccatcggctccaacgccctgccgctgggcttggccgtggaagtggaatccatctttgagatcgaggaggcctgaacaatgctgggaagggatgttagccctgtagagatcgcggacattttcgcggcagaacagagactccggaaagtctttccgccctctccgctgctgaacatggaattcctgaaccagcagctgggtgcgcaagtctggttgaaagcggagaaccttctgccgtcgggggcctataaataccgcggcgccatgaacaagatcacttctctgatcgagcggtacggcaaggagcttcggatcgtcacagcttcctccggaaatcatggcatggcttgcgcactggccgcccggaatctgggggtccaagcaaatgtcgtggttcccgtgtccacgccccagatcaaaaaggacagcatccgcgcactgggggccaatttggtggaagtcggcgcgacatatgacgagtccttcgtctctgcctgtgaactggcagaaaaagagcatctgtactacgtgcaccccacctctgaccggtatactgtgggcggccaggggaccatttccctggagattctggaccagtgcccccaagtagagcagatcgtggtgcccatcgggggcggcggcctcatcacggggatcgctctgaccatgaagacgctgaagccctccgtcaagatctatggtgtgatgccggcagggtcggctgtctatgtggaatcccgtcggcagggccagctggtgacgctggatcactgttcctctatggcggatgcagttgtacggaaaaccggcgaggaatacctgtatccttacattgaaaaatatgtggatgacatctttacagtcacggaggacagcatccggcaggcggtcagaacagcgtgcttgtatggaaagctgacgctggagggctccggtgccctggccttggcggcgttgctggagaaaaagtgtccgctcagtcccggaacggttctgatctgctccggtggaaatatcgacaaagctgttttggacctgtgtatgcaggcttgagaggaaatgatggctatgatgaccgtgaatggccagcggctccaagcacatcttgaggccctggcggatattgcccgaaccccggacgggatttgccgactctcctattctgacagcttttggaagtccaacgcctatgtggcgcagctgatgcgggaggctggcatgagcgtcaccaccaatccagttggaaatgtggtgggcacttatcctggcaggtctccgacaaagattaccataggctctcacatcgattctgtagtaaatggcgggatctttgacggctgcctgggcgttctcgcggggatcgaagcggtccacaccttatctgaaaaggggatcgtccccgaacacagcatcgacgtggtgtcctttgccgaggaggagggcattgtgatcaccggactgatcggcagccgtgcttactgtgggttgccacccacagagccggtgctagagaagatgggggagttcggatttacccttcaggacttggcagaggcgaaatacacgggagacatcgattactcccttgagctgcatattgagcagggcggtgtgctggagtcccagaagaaggatatcggcgtggtccgctcgatcattgccctccggcgctatatcgtggagtttgcgggcgtggccaatcacgccggcacgacgcccatgacgctgcggaatgacgcgttggtcaaggcggccaggttcatcatgcgggtccgccaggtggtcatggagaccgacccccacatggtgggtacggtagggcatctggaggtgcagcccaacgccatgaacgtggttccgggccgtgtggctttgacgctggagctacggggactgcgggaggatctgctggagtccgtttatcagatgctgatggaggagttccggaaggacatcgtctcctgccggctgacgatggaacagccctgcttccatatgtcggaaaccgtgcagcagagcgtccggaacgcggcccagaagctgggacttgcggcgatgactatggacagcggagccggtcacgacagcatgagcctctcgcaggtgacgagggtcggcatgatttttgtcccaagcgtcaagggaatcagccacagcaaagaggagttcacgacgtgggacgatgtgaccaatggagcaaatgtcctcttgcacgccctgtgtgacatcgatcgccttgaaacacccgggaggtgaattttttgagcgagaaaaacgactatatcattgagatgcacggcatccagaagagctttggcggcgtcaaggcgctgcgtaacattgatctgcaggtgaagcgcggaagctgccacgcccttctgggcgagaacggcgctggcaaatcgaccttgatgaaggtcctgaccggtatcattgcaaaagacagcggaaagatcctgctcaatggggaggaggtccagatccagagcctccgccatgcagaggagctgggcatcgccatcgttccgcaggagctgtcctttatcagctattttacggtggcggaaaacatcttctatggcgaagagcctacacgtcctctgcctctgctgatcgactggaaaaagctgtataccgcctgtgatgagaagctcaaagagctgaaaatcgatctgcccagcaaaatgcaggccggaaagctgaatgtctccgatcaacagatgatggtcatcgctcgcgtactggcaaagaatgccaacatcattatcatggatgaaccgacggcgcgccttggtcatggagaagtgacgaagctgctgaaatatattcaatatctgaaaacctgcgggaagaccattatttacatctcccatcgtctggaggaaattttcgagatctgcgataccatcacagtcctgcgcgacggcgagacgattcagaccgctcccacctcccagatggacagcgacaagctgatcaacctgatggtcaaccggcagatcaaagtcaacaccacccggacccggaagagcagcatcggcgagaccgtcctctctgtaaagggactttcgaaaaagggtgtgctgcgggacgtctcgtttgaagtccacaagggtgagattttggggatgttcggcctggtgggcgccggtcggacagaagcggtccgcgccatgctgggggttgaccggtatgacacggcggaaatccggttggacagtaagcccgtcgtattcaaaaacatcggacaggccctagccgctggcgtcgcgcttgtgccggaggagcggcggaagcaggggatccttcccaacacgccgatttacaagaatgtgtccatctgcaatctgaaggcgctgtcgcgtctgggcctgatcgacaagaagaaggaactggaatacgccaagcactgcacggagatactgggcgtcgcctgctcctccgtattccagaatgtgggaaatctcagtggcggtaatcagcagaaggtagtcatttccaagtatattgaccgcaatatccgcgtgctgatcctcgacgaacccacccgcggcattgatgtcggtgcgaaagatcagatttatgaaatcattgagggcctggcacagcagggaatggcagtgatcgtgatctcttctgagataccggagttgcagctgatgtgcgaccgcatctgcgtcatgagccaggggaaagtgacgaccgtgatcgatcgttctgaatttgcggattccgataatattctgcggaatgcaatcggaatatgaggatagggaggagttcattgatgaacgccaaattaaatgtttccagaattgcccggaattacgggacgcttttcgcttatatcatcatgctgctggtgttctcgatcctggcgccgagtgctttcccgacgctttccaacgtgatcagcatcctgcggcagatcgccatgctggccaccatcagcctgggcctgaccttcgtcctgatcaccaagcgctcggatctgtccatcggctacagcacaagcttcctcgggatcgtagtggctgcgctcctggtcagggctggaatgaacatatggcttgctgcattgatcacggtccttctcggcgcactgattggactgatcaacggcgttgtgatcgcctatctaggagttccggactttattgcatctttgggagtcggttacgtggtggctggcatcaatcaggcctataccaaaggccaccccatctccaatctcccggcggactttgagatctttggcgctcagcgactgggcggtgtgatcccgaacgcggttatcatcatgctgattgtactggtcgtgtctagcattatcctcaaccagacaaagttgggacgatacatatatggcgtgggtgataacgaagaggcatctctgatgtccggcgtcaatacgcgctccaccattgtgtgggcctatgttttctgcggcattgcctgcggcgtcacggccgtgatgctgacttccagactgggctctgcgcatcctcaggctgcggaggattacttgctggatgctattgcggccgtatggctgggcggcaccgctttcaaagacggtgagccgaatctggctggtacactgctgggcgctctgattatcggaacaatggccaacggcctcacgatcctcaatgtctcctactactatcaggatattgcgactggcctgattattctcgccgccgttattatcacctcggttcagaagagccacaagaattaacgaaggattggagaatacttgtatgagaacactggtaaaaaacgggaccattgtcacagcagagagtgagtacaaagcagatattctcattgtcgatgaaaagatcacgtcaatcggcaccaatctagaaggcccctttgatagaatcctggatgcagagggcaaatatgtgctccccggcggtgtggacaaccacgcccactttgaggcgctcaatacggacggcatcaccacaaacgagccctatgccactacctgggtggccctgcagggaggaacgactaccattgtggacttctgcaccaatgaacccggcatgaacctggtggattccgtcaactaccgcctgaatgtccgcgccaaaggcaaggtggctcccgacatcgccattcacgcctgctgcaacgatttcacggatgagaccgtcggtgagatcaaaaagctggtggagatgggtgttcccaccatgaaactgttcctggcctataagggcacctccctctacatggatgacagcaagctgctggcctgcctggaggaggctggcaagcagggcatgacgatgatggtccatgcggagaatccggacgttctggataagtgccgcaatgatgcggccgctaccggacactatgagccaaaataccactacatgacccgccccccctacggcgaggcggaagccgtctcccgtgccatccggtttgcggatgccatgcactgtcccatgtgcattgtccatgtcagctgcatcgaggctggcgaggagatccgcaaggctcgtgcggagggcaaggcggtgatcggcgagacctgtccccactatctggtgctggacaagcacaagatggaccatccggactggcacatcgccgcccggtggatctgctctccggccctgcgggacaaggaggaccaggattacctatggaaggcgctgaataaggattggctgtccatctgcggctctgacaattccggcatcccccaggcacagaagaactggggctgggacgaggagcatcagcgctgcgacttccggatggtccctaacggttgccccggcgccggcgaccgcatgaatgccctgtggacctatggcgttgccgccggccgcatgacacggcagaagtttgtggatgtgtgctgcaccacgccggccaagctgaacggcatctatccccgcaaggggaccatccaggtgggcgctgacgcggacctggtgctgttcgacccggactacaaggggacgatcacgctggagaccaaccccactggcgtggagtacaacgtgttcgagggcctggagcaaatcggccgcgctgatacggtgttgctgcgcggcagcgtcgtggtggaaaacggcaggtatctgggtgaagttacagaagttgtggctgacggcattacctatcagggatgcaccagcgccaacggcaagtttattcccggcaaaccctatggtttgggatatgacctcttgaaaagatcataagaagaggattgcaatcgggatgaactccttgaactttcacggatgtataagagacgatgttgatcaatttcctatcaatgctgtaacagggcgccgagtacatactcggcgccttctgtcatcatccagtttgcatatgcgaactacctttattacatagggaacgttgtaagtgtaaaacgattataagaatatgaggctatcccgccgaaaggccgatcttaacttatatcgtctgtatctcagaaaatatttcctgttggcttgacaaagagggcgtgcccattttgaagaaattgacgaaaccattatctgcttagtacgatgactggaatgttaatatcatcaatctgctggagacctacgaccgtctgattgcgtttggtcaaaagaacctcagcaccccctttgtgcaggagggcatccagagcatcagcaccagaaatcgcatcctgcgtgagctctgctcccaaaacccgcccatctccaaagtgttccgggagattgggctggcggacgaacagggatccgggatggggaatacttataagtacacaaagctctactccggcgggagcccggaatttattgagggtgacgtgttccacacagtcatgccgcttgctccaattacggctgaaatggttggaccgcaggacgtcacccatgtgaccctacatgataccctgcttgagcgtatccttgttttttgaacggaactgcgctctaaagcgaggattatgcaacactgtggttttcaggatttcaaacatttcacgcagaagtatcttaaacttttgctgaaccttgggatgctgaagatgacccttcccgataaacctcagagccacagccagaaatatatgacggtgcaaggggctgtacctaaaaattgaacacaatttggaataaagaattgaaggcatgatcttgggtaataaaagactatattgtggcgaaaagctttgataagttaggctgccttgcatacctctgtaagacgtctaatgaggcttggtacctttcaggtatactagaggttctgcaggctgtcggcgtccagatcgtgatcctggatggtcctgagatttattcggagtgtgtccctacacgtatgtggaggacatggagaatatcattgatcggggggacagttggacaggggtttataatgcagaagattacccggagatactgaggaagaattccatgccgcttacgataaagaggtccagaatgagcccgtcgggaagattaggccttgtttgaaaaataaaagttacacaagaaaccaagttatgcgaagctatgagcatgaaacgatatgaattaacaaaagaacaatgggaacggatcaagtcgctgctgccaccagaagaaatgggaaagcgggggcgcccccggaaggataacccgattatgctcaacggaatgctctggatcgtccggagcggtgcgcagtggcgtgaactgccggagacttatggcccttggcagtctatatacgcccaattcgctaaatggggggatgacggcactctggaagtggtattccacacactgtctacggacgcggatatggagaacctgaacatggactccacctgcgtaagggtgcatgaaagcgcaaatggcgaggaaaaaacggcagataaggcggttggccgtaccaaaagcggatggaacacaagactccacgctgttgtagacggtctgggaaacccgctggagttccggatctccgctggaaatggccacgattcggttcacgctgttgaactgccgcaaaaggtcagaatcggcaggagtgccgtgccgccagaccgggcctatggtgcccggacgattcgggaatatatctcagcgcacagggccagctatgtgatcccgccgcaaagcaatgtttccgatccctggccggttgactggcatctgtataaagagcgccatctggtgaagtgtttttcccagaaaatcaagtggtttcgcagaatcgccacccgatatgacaagccggatgcttccctcttggcctttgtgtattttgccgccatcgctattttgttactttagcacaatctccgccttttttcgaataagccctagtaagcgaccccatcctttttacggataaccggttgggaaatggagaagcaaggatactgccgatatccggtgatttgcgcgtgagggaagaatatccgggcagaaagccgttgccgggtgaaagcgcctaacctgttgggcacacactgctgttaccgtcatcctcacaaccgtttctgaaaattgcccgccacggaaacatcctcatccatgataataaaggaattgggatcttcttcccgcaggattttccgcaggtggagcgcctccttcttagaaactactgtcagcagcaagtcggacggctcgttgctgtaagctccgacgccagtccacttcgtcacgccgcggccggcatatcggaacaccaactgctccatggcctcagatttggtgatgatcagcatggtgaccattacattctgcaagtgcatccggtccagagtcaggtaggtggtgcagccgaagatgatgctgtaaaccaccacgtcctgttcaaacaggaggaggccgatcccgtatacgaacacattcaggatcatggcgattcgccccacgctgaaatccggctttttctggacgcacagcaaccccaggatctcctcgccgccgccggagcatcccgctgtcagcgtcatgcccgccccgacgccgcataccagcccgccgatgacgcaggccgcgattgtctcgtcaaacaatccttccgccgggatcgggattagggccaaaaaggcactgtaacagacgatgcaaagggcggtctttgcaaagaaaaagtgcccgaaccggaaccaggaaatcagcagtagaggaatattcagcagaaaataaagaatgcccgccaagtcgccgatctgctggatggcagggaagaaatgcagcagcagcattcgcagcagctgcgcgattcccaggaatcccccgctgtacatatcatgcggcagaatgatccagttcatggaggcggaaaacagcagggaacccaggatgatttgagcggcttcctgcaccggatgtcccttgtacagctccagtgccgtggggctgtcatgcgtttgctccatttctcatctctccttttcgctctgtggagaagccctggcacaatctgtgccagggcttctccacaacttgatcttactcagtcgccaggccgtgttccaccaggaactggtgggccacctcctgggcgctcatgccgtccacgtccacttgggcgttcatggcagccatggtcgcctcgtcgatggcaccgtccagtctggacagtatctcggccagttcggggtcggactccaggagctcggcatccacaaagttcacagcgtagtaaggcgggaagaagctcagatcgtcctccagcatggtgaggcccagcttggacagcagagcatcggtggcaaaggcgtccaccacgtccacctcgtcgttctcaatggcggtatagcgcaggctggcgtccaggcccttcacgtcctggaaagcggtgccgtacttgctctccagcaggggcaggcagtcctcgcggtccataaactccaccgtgcagccgagacgcagctccggggacttctcaatcaggtcagacagagaggtcaggccatatttctccgcagtctcgggcttgacgctcatcacataggtgttgttatagcccagggggttggaggtctggatcccgtgctcctccagcatcagatcgtggacggtctgccacacccggtccttatcggtgtccataggctgggccagcaggttcagcagcgccgttccagtatactccacaaacatatcgatgctgccctgctccagggcgtcaaagcacatggccgcgccggacaggccgaaacgctgttccacctcataatcggtatttgcctcgatcagctccgtgtagatctcacccagaatgttgacctcggtgaagttggaggtgcccactacgatggtcttctgatcgccgctgccagcttcagacccgctgccgcccgcatcagagggggtcccgccgcaggcggccagagagagggccatggcggcggccatcgccatacaggtgaatcgtttcaagtgtttcatacaaatagactccttttcagaatggggtgttgatatggttgagatatcgaatctgcctcacagaggactcatgcgatgatagaggcgtaggatgccacagaaaccaccagcagggctccgcacagcgcggcggccatcgccttccggcgggaccggaccgacaggctcaggtttttgatctggtcctgaggcagcagtccctcgctggtgaaggcccgctccacgcggcccaggaggaaatccagagtcagtgccatcagcgcggcggccacggctcccatgatcgtcatggggtaattcagggagttcatgcccagctggatgaaggagcccaggccgttggcaccggcgaaggcggcgatggtcatggtgcccacagagctcaccgcggcgatgcggatgccggacatgatgtacggcatggccatgggcagctccacccggcgcagctgctgcatccgggtcaggccgatgccccgggccacttccatggaaacgggggaaatgccggagatgccggtatatgtatttttcaaaatgggaaggaacgcatagacgaataccatgaaaatggccagcgtctcacccacgcccagaaagggaatgcccatggcgagcagcgccatacaggggatggactgcatcacgttggcgattccgatcaccacattggataccgctttgttccgggtgatgaagatgccgaggggaacggcgatgatcagggccagcaccacggagaagctggtcatggccaggtgccggagaaactcctccagcagactgtcccactcctccacataaatggagaaataatccatcaaagtgtagcgggacatatcactccgctcctttctccggcggtatgttccggaacgaactgcttgctcatggtggccagaatgatgctcttcgtcaaatagccgagcagcttccggtcatgctggatcacgggaataatgccggacacatcgtaatcaatggtggcgatgatctctttcagggaagtttccccctccacggcgatgtaatcatcggatatgtagtattctatggggtcggcctcccgctttccgatcagctcctccagccagacgacacccaggagcgtctgccccttatccagcaccagcaggctgtccacgctgttgtgcctcatgatctgcagggcctggatgacggtgcgcccctttgaaatagtgaagggacggcggcgcatgatgtccgctgcgcggatatattccgggttggcccacagccggttggcgccgatgaactctgtgacgtactggttcgcagggtgctttagaatgttttccggggtgtcacactgggcgacttttccatcctgaatgatgcagatgcggtcggccagcttgatggcttcgtccatgtcgtgcgtgacgaagaccaccgttttttgcgccttggtctgcagatcatggatttcgttctgcagctccgcccgggtcatgggatccagggcggagaaaggttcatccatcaggacgatgggcggattggcggcaaaagcccgggcgatgcccacccgctgctgctgaccgccggagagctgggatgggtactggccccggtagatttccgggtccagattgaccatcttcagcatcttatcgacccggtcccggatggcctctttggaaaaacgggcgatctgcatggtgagggcgatgttttcttccaccgtcaggtgggggaacaggccgcccgactgtaccacatatccaacctttttgggaaggtcctggaccttgatctgttctacgggaatgccgtcgatggaaagcgagcctccccgcaggggaagcagcttgttgatgctcttcagcagggtggtcttgccgcatccgctggaaccgatcaaaacgaaaaattcgcggtcatggattgtcagcgaaacaccgtccaacacaggcttatctttgtaggcgatgcgaacgtcttcaaattcgatcatgtctcctccatcttcacatcgtaattgaatcgagcgctggtttgcccatattatgggctgtgatttattaaaatgggattaagttctgctcagcgggcattaagattccatttcattgcgtgtgaggtgggggcggagcttctgaatgggctccagaaaggaaatgcgaaagctgggatatacgccgcctacacgcctcttaatccaatcttaatgctgtgggcgaaatacttatataattatggtatcctgcatgataggataaggctgttgaattccgatccagaatcatgggagatgaagatatatggaaaaaacagagaacagcactccctattccccccggtacggagaggcggagaccggaggcaccggaagactgaagatctttttcgggtacgcggcaggcgtgggcaagacctacgctatgctggaggcagcccatcaggcgcagaaagaaggcgtcgacgtggtggtcggctatgtggagccccacgccaggccggatacactggcgctgctggaagggctggaggtcctctcatgcagggaggtggactaccgggggatccggctgcgggagtttgacctggacggagccctggcgcgcagaccacagttgatcctggtggatgaactggctcacagcaacgccccgggctgccgccacaccaagcggtatcaggatgtggaggagctgctgcaggcggggatcaatgtctataccacagtaaacgtgcagcacctggaatctctgaacgatcttgtcacctccatcacagggatcgtggtgaacgaacggatcccggatcacgtgtttgaccgcgccaaccaggtggaactggtggacattgcgcccgctgacctggaaaagcggctggaggaggggaagatttaccggcagcgccaggcgaagcaggcgctggagaatttttttaccgccgagaatctgacggccctgcgggagatcgccatgcgccggacagcggaccagctcaaccgcacggcggtccaggagaaaaaggggaaggccgcgcgggcgggagaccatattctgatctgcctgtcctcagccccctccaacgccaaggtgatccgcacggccgcccggatggccgaggcgttccacagcggcttcacggcgctctttgtccagacaccggagaccaaggagctgtccggagagaatatcaaacgcctgcggagcaacctgcgcctggcggaacagctgggcgcacagatcgccaccgtctatggcgcggacccggcggaacagatcgcggagtacgcccgggtcagcggtatcacgaaaatcgtcatggggcgcgtgaatcaccggcagcacccctggatcgggcagaaaagtctggccgaccggttgatcgagcggacggacctggatgtgtatatcattccggaccgccagccgctctataaaaagccccttggaaagctccggaagtccagagtccgcttttcctggagagacgccgtggtcacgctgctgtgcctggcgatctccacagcggtggggtttgcctttgattgggcgggcttcagcgaatccaacatcatcacgatctacattctgggcgtattggtgacagcagtcagcaccagcgggcatctgtatggagcagccaactccctgctgagcgtgctggcgttcaacttcttttttaccgagccgcgcttcaccctccaggctgacgggcccagctatcccgtcacgttcctgattatgctctcatccagcatcatcgccagctctctggccagccgcgtgaaggagcaggcccgcatggcggcggaaaagagctactatacggagctgctgctgggaagcagccaaaagctgcagaccatccggacggagtgggactgtctgcgcctgacggcggagcagctcagccgcatgtttgaccggccggtcatttatgccctgaacgacgccgacaaggagctggacttccggatcgagccggcggacgaacacacgcttctggaaaagctgagcacggaagagatcggcgtcgccaaatgggtgcagaaaaacaacaagcacgccggcgccaccacgaatacgcttccggactcaaaatggctgtttctttccgtgcggggcacccgcggcgtgatggggatcgtaggagttcccattgctggttatgtggtcccggacgcttttgaaaaaaacctgatggtggcactcctgggagagtgcggcctcagccaggagcgtattcgtctggaggaggagcggaaccagatcgcgctccagacccagcgggagagcctccaggccaatctgctccgggcggtctcacacgatctgcgcacaccgctcaccaatatcaacggcagtgtgggcatcctgatggggaaggatcagacgctcaagccggaagtgcgcgagcagctgtataccgcgattgacgatgacacgaactggctcatcaacatgacggaaaatctgctggcagccacacagctggaaactgacaggaccaagctgaaaaccgctcccgaactgctggaggatctgtttcaaagtgctgtccggcagttggaccggcgggcaagggaccaccacatctcagttgatctggaggaccagacgctcatggcgtccatgaacgcggggatgattcagagggtcatcatcaacatgatgaacaatgcgatccaatatacgcccaaggactcccatatcattctgagcgggacccgcaggaaggactgggtggagatcagcgtctctgatgatggccccgggatcccggatgaggcgaaaaagcacctgttcgatctgttttataccgcggagcagggaaagcctgacagcaagcggggactggggctgggactgcatctctgccagtctatcgtcaatgcccacggggggacgatcaccgtctccgatcacgcaccatcggggacaaccttccggttcaccctgcccgcagttcggacagacggcgtgaaatgagcgtccaggacggcggtttttcattaatgttttgttaataccgccagaaatttcttaatccccttttataacgcgctgcgctattctagaaaacgcgaacgggagaatagggggcatctgtgcctgctacccggagcgaaaggagaatcttatgaaggagtatctgctgattcaagtggccgccgctgctgccattgggatcgccgcgtggcggactcttccggagacgatgatgtgtgcagcctgcgggcagctccaaagaagaaaggagttttcaagatgatggatgtattgatggtaggcaccctggcggtcagcttcggcctggtatggctgctgatccgctggtgtcagaaacagctggacgacccggagtcgtaagcgcagaaaggagatcataaccatgattgcacttggaattatcgttctgctgctgggcgcttatctcgtttacgcgctggtgcatccggagcgtttctgagatgcctgataccgcagaaaataggaggaatacgatatgttgcagctggcgctgacaatcatcatctttctgatcattgtcattccggttggacggtatatgtatcatatcgccacatggaaccacacactggccgacccggtctttgaccgtctggacggcgtcatttacaaaatcggcggcgtgaatccccatcagggtatgaactggagacagtacgctctggctctggtgggaaccaacgcggtcatggtggccatcggctacctgatcctgcgcattcagagcgtcgggatcttcaaccccaacagcatcggcaacatggagccgaccctggcgttcaacaccatcatcagcttcatgaccaacacgaacctgcagcattactccggcgagtccggactgagctacttaagccagatgctggtcatcatcttcatgatgttcgtctctgccgccagcggctacgctgcctgcatcgcgttcatccgcgggctgaccggcaagaccaaggacgacgtgggcaacttcttcgccgacctgacccgcatcaccacccgcctgctgctgccgttctccatcgtgggcggcctgctgctggtgtggcagggcgtgccccagaacttcgacgccaacatcgtggtgaatacactggagggcaccttccagaccatcgccatgggtcccatcgccgcacttgagatcatcaagcacctgggcaccaacggcggcggcttcctgggcgcaaactccaccaccccgctggagaaccccacgatcatctctgacatgatcgagctgtactccatgatgctcttccccggcgcctgcgtcatcaccttcggcaagatggtgcgcggccgcaagaagaaggatgccgccggcgacaaggcgctggccggcagcgaatccgccggccagctgtctgcgggcggagctgagcagggccccgcctgaaggaccacagcctgacggcgtccatctacggctgggagggccgcacgatcttcctggccatgggtatcatcttcctggtcggcctgggcgtgtgctactggtcggagctccagggcaacccggctctggcaaagatcggcctggatcagtccatgggcagcatggagggcaaggaggtccggttcggcatcgcccagtcggccatgttcaccaccaccacgacctctttcaccaccggcaccgtcaacaacatgcacgataccctgacgcctctgggcggcatgatccccttgctgcacatgatgctgaacgtggtcttcggcggcaagggcgtcggcctgatgaacatgattatgtacgccatcctggcagtgttcatctgcggcctgatgattggccgtacgcccgaatacctgggcaagaagatcgagggccgggagatgaagctcaccgcgctgtgcatcatcatccatcccttcctgatcctgttcttctccgcgctggcggtctccacctccggcggcctggagggaatcaccaacccgggtttccacggcctgagccaggtgctgtatgagtacgcctcttccgcggccaacaacggctccggctttgagggtctggcagacaacagctacttctggaacatcaccgcaggcctggccatgttcttcggccggtacctgtccatcgtgatccagctggccatcgccggttccctgatgcgcaagcggtttgtcaacgagaccgtgggcaccctgcgcacggacaccctgtccttcgctgtgatcttggtgttcgtagtctacatcttcgcagcgctgaccttcttccccgcgctggcgcttggccccatcgcagagcatctgaccctgtgggcctaaggagggcgttttcatatgagtaagaaacaaaataagaaatttatcaccccggagatcctccgggggcggtgaagggcgcgttcgtcaagctcaatccccgctatatgatgcgtaaccccgtgatgtttgtggtggagatcggctgcttcatcaccctgctgctctccttcttccccggcctgttcggggacgtggacgcaggctccctgcggatctacgacatcatcgtatgcgtgatcctgttcatcacggtgctgttcgccaacttcgccgaggctgtggcggaaggccggggcaaggcccaggccgccagcctgaaaaagacacagaaggacacggaagcccacctgctccatgaggacggcagcgagaccatcgtccgttccagtgagctgaaaaagggcgacatcgttctggtggtggctggcgaggtcatccccggcgacggcgaggtcattgagggcatcgcctccgtggatgagtccgccatcaccggcgagtccgcccccgtggtccgcgagagcggcggcgacttctgctccgtcaccggcggcaccacgctggtgtctgactggctgaagatccgcatcacctccgagccgggcaacagcttcctggaccggatgatcgccctggtggagggcgccagccgcaaaaagacccccaatgagatcgcactgaacaccctgctggtgtccctgaccatcatcttcctgatcgtggtggtgaccatgtatcccttcgccgtatacagcggcgtacagatccccgtctccaccctgatcgccctgctggtctgcttgatccccaccaccatcggcggcctgctgtccgccatcggcatcgcgggcatggaccgtgtcacccgcttcaacgtcattgccatgagcggcaaggcagtggaggcctgcggcgacgtggataccatgatcctggataagaccggcaccatcaccttcggcaaccgcttggccgccgacttcttcccggtggagggcgccagccgcagcgatctgatccgctgcgcggccctcaccagtctccacgatgacaccccggagggcaagtccactctggagctggcccgccgcctcggcgataacagcgtggagcccgcgggttccagcttcctggagttcacggcccagacccgcatgagcggcgtggacctgcctgacggcaccaaggtgcgcaagggcgccagcgacgccattgagcagtatgtgaaggaaaacggcggcaaggtccccgcggatctccgcacccatgtggaggaggtctcctccctgggcggcacgcctctggtggtgtgcgagaacaacaaggtcctgggcgtcatctacctgaaggatacggtgaagcccggcatggtggagcggttcgagcgcctgcgggccatcggcatcaagaccatcatgtgcaccggcgacaaccccctgaccgcggccaccatcgccaaggaagccggcgtggacggctttgtggcagagtgcaagcctgaggacaagatcgccctgatcaagaaggagcaggccgagggcaagatcgtcgccatgaccggcgacggaaccaacgacgcccccgccctggcacaggccaacgtgggcctggccatgaactccggcaccactgccgccaaggaagcggccaacatggtggacctggattccgaccccaccaagatcctggaagtggtggagatcggcaagcagctgctgatcacccgcggctccctgaccaccttctccatcgcgaacgacgtggccaagtacttcgccatcatcccggccatgttcaagctggctgttcctgagctgaacgtgctgaacatcatggggctggcgacctcttacagcgccatcctgtccgcgctgatcttcaacgccattatcatcccctgtctgatccccctggccatgaagggcgtcaagtaccgccccatgtcctccgggaagatgctgggccggaacatgatgatctacggcctgggcggcatcatcgcccccttcgtgggcatcaagatcattgacctgatcatcgccccggtgctggctgccctcggctttggtatgtaaggaggaacctgaatgatgaacgagaagaaacatggcattggccacaatatccggcaggccgttctggtcaccgtggtattgctggtgctgtgcggcctggtatttccggtgctgctcagcggcctctctgctgtgattttccccagccaggccaagggctctctggtgacggcagacggcatcgccgtgggcgccaagaacgtgggtcaggacttcaccgaggattactttatgtggtgccgtccctccgcgtacaattacaatacttactatgaagaggacaccgacggcgacggccaggtggagcagtactacaacgacggttctgaattcgccggcctgagctccggctccaacaactacgccccctccaaccccgccctgacggagcgggtggaagcggacatcgaggaattcctggagaagaatcccggtgtcagccgggaggatatccccactgacctgatgactgcctccggctccggcttggatccccacatctctcccgcctctgcggaggtgcagattccccgcattgtggaggcctccggcctgagtgaggatgaggtgcgccagatcatcgccgacaacaccaagggcaagaccctgggcgtgttcggagaggagaccgtcaacgtgctgggcgtgaatctggacatcgccctggccatgggcctggtgggtgagatctccaagtaatcacgggccccggatgccttcttgggcagaggacactggtatgcagtttcattttgagaaaacgctggaaaagcggtatgagccgcaggtcactgttacgaacgagaccccggcgtggctgatgatttgcctggcggagtccataaaggactggatcggccagagtcccagaatcttttgcaaaagtgaggagccgtacctgcagttcggctatgaggtgctgacgttcccggttgcggagtttgcacagattttcggcccgctgatctatgcgatcaatcaggcatggcctgtgcaggtatttggaatgggaagccaggatgagctggtcgagctgtccttcacaaaggaggggacagcccccactatccagcagaagaacgtctccgggattccatgtgcggaattgagagacctgtacttttgcgtgaagttcccggatcctctggcggcggactgtatgttccgtttgctggacgcggtggagaaaaagtctgctgccgtggccctggagtgggagtacgccgattttctggaacagcagcggctggcaagaattgaccggacactctcctattgctatgtctcccttgaagaagaggagagcgcggacccggtcggatggctttccggactgacgcttcagcagaaatgcgaactgtggcggatgtttttgggaaagcggctatttctgccggaattcgaatggctcagagatgcaatgctccagggagctgttccaaactggatcgagtggcatttagcactctatcgtgttctggaggaagagaacattcgctttttctgtaaggacggacaatttgagctgctggacaaggaaggacaccgcatctatttcggtgtagaccattccgaggcggcagagcaggtgctgatgaaagtcctgttcccgctcaaccaatgaccgagagattctgaaataaggctgaaaggcggaccggtacatccggttcgcctttcagcctcttatgattccttaatacgggaaacgctttctttttcccgatttaagctgaaaagcagtatgataaggccaaaggaagggatgattatgatgacctggaaaacgaggctcctgcattttgagcgcatgtgtgatgggctcgtggagcatttcctgcttcaacacaagatccttggatttctattgatttttattgggatgcctctggtgacgctgtcggcagtatgtatttgctccaccgttcttgtactgccgctggccttggcgtttgggtacctgtgaagaggaccttaatacaattttaatacgagcccttaaaaattaatgcccctttaagacgaaaagtggataatgtgattaagactccataaagacatattaaggggtggggcttacgcagcggccttttcataaaagctggtcgtctccgtttcggatcatcatattcggatttctcttggtgattctgctggggagcttcctgctgatgcttccggttgccacaaaagaaggtgttgtcacgccgttttcggatgctctgtttactgccacgtcggcggtatgcgtgacaggcctggttgttcacgacactgctacttactggtcgaatttcggacagttcatcatcgtattgcttatccagatcgggggccttggggtggtaaccgtggccggtgctttcggtatcctctccgggcgccggatcggcctgatgcagcgcagcacgatgcaggaggccatcgctgcgccgaatgtgggcggggtcgtgcgcctgacaggttttatcctgaaaactgccttggtggtagagctgttgggggctgccgcgctgttccccgttttctggcaggaattcggcttgataaagggactttggtatgccctgtttcactctatttccgccttttgcaatgcgggattcgacttgatggggatcaaggagcccttttcgtctcttgtggattacgcggacaacccggtggtctccgttgcgatcccgctgctaattatcatcggcggcattggattcttgacttgggatgacatccgtacgaaccgcctgcacataaccagataccggatgcagagcaaggtgattctggtggtcaccggcagtctgattctgcttcccggcatctatttcttcctgttcgagtttgcgcgggagcctgtggggaagcgactcctcttatcctttttccaggcggtcacgccccgaactgcgggttttaatacggcggatttgaccgctatgagcgaaagcgggcagacgattatcaccatgctgatgctcataggtggttcgccaggctccactgcgggcggcatgaaaacgacaacgctggcggttcttctggcgaacgcgctggcggtttttcggcgcaatgagtatccgcatttctttaaccgccggatctccaaagagaccatctcccaagcggcgacaatttttgcgatgtatctggggctgtttctggccggaggactggtaatcagccgaatggaggggcagcctattctggacagcctgtttgaaacggcttcggccatcggaactgtgggcctgtccttgggactgacgccgcagctgcatacggtctcacgcctgattttgatcggcctgatgttctttggacgggtagggggctgacgctgatattcgctgccctttccagcacccagaattccagcgcccgactgccgcaggagcggattacggtagggtgaatctgtaaataaagaggatgaaatacatgaagacaattttgctgatcggtttaggccgcttcggccgccatgtggccatgaagctccacgaattgaaccatcaggtgatggcggtggatcaggacgaggaaaaagtcaaccggattttgccctatgtgaccagcgcccagatcggagacagcacaaacgaggaatttttggcctctttgggggtgcgaaactttgatgtatgtatcgtcgctatcggcgataatttccagagttctctggagacggcttccctgctgaaggaggcgggggcgaaaaaggtggtggcccgggccgcacgggacattcaggccaaattcctgctgcgaaacggggcggacgaggtcgtctacccagagcggcagatcgcggtctggaccgccatccgatacagctcggataatatttcggactatatcgcgctgggggacgatcatgccatctttgagattcaggttccggataactgggtcggcaagaccatcggccagctggatgtcaggaaacggcatcatgtgagcatactggccatcaagcagaacggacacttcgccatgacggtcattacgccggagacctgtctcccggccaacagcaccatgctggttttgggaacaaaccagaacgttcaaaaatgcttccacatctagcggctgcggctccaggcatggaaaggacaggttgggatggagtatatgattttgcttggcggccttctcgtgtttgcgctggtcggtttctggatgatgggaagggttgacaggtttctgaatgcggcgcgggcagagcaggaggggcggcagcatgccgagtgcttgaagatcgcggcatcggacccctgtgtgatgcagcctgtttttaaaactgtgtcggcgcttaaggagcagcacccggacttgtggtgtgagctgtccttcggaagagaagcggaggttttgggatgtctcagcacaggcaatgtggacgttgcgattctccccggtgagacagggggcggagcggcgtttgaaagcagagactttctgttttcgccggtttctttccgggcggtggaggattgcacgaccttgtcatctatcgacacaagcgtgcggcggcaaaggatattgctgaaacagaatacatctgcttccctggctgcggaatttgttcagagaatttgtgaacagaaaccgtagaaacgtgctataatagagccgtttgaagggaggcggtaatatggagacttctgcgcaggtcggacggggagagcggaggcggaaaggatcccttacgatttttgccggttatttctccggcacgggaaagacctaccggatgctggaggctgccggccgcgccgtgcgggctggagaggatgttgccgtcggcctgctctcctgcagccaatggccgcagacgcagatcttggcggatggctttgagacgctgccgctcaaagcgttttcggaggcggggaagaccgtttatgagcttgacgtggatgcctgtctgaagcgcggcccaaggcttctcttgatcgacgagctctctcatgaaaacgcgggcggctcccgccacagaaaacgctgccaggatattgaagaactgctgcaggcagggattgatatctatacgacgctggatgtacagcacattgagagtattcaggacaccgtttccgaaattttgggcgctccggccgaggagcggattccggacagggtgttcgatcaggccgcgcgcgtggaattcgtggactgtgaaccggaagacctgcgggaacgcctgatccggcaggaccggacggatctgctgtctgaatattcacagcccaaattgagcgcgcttcgggagcttgcccttcgccgctgcgcggaccggacggctctggatacacaaaagagccggggcggagagaggtaccggacccgggagcatgtcctggtctgcctttccgcagcaccttccaatgaacgtgtcatccgaacggctgcccggatggccgacgcgttccgctgcggctttacggcgctgtttgttgagacaaaaaattttcagtccataccgcagccggatcggaaccgtctgagggccaatctgcgtttggctcaacaactgggtgcatccgtcgagacggtatatggcgatgacgtggcctaccagatcgccgaattttccaggctgtccggcgtgaccaagattgtgctgggccgtggagagacttccaaccgcatcctgttttggaagccctcgctgacggaacggctggttgagctcacaccggaactggacatccacatcattcctgacactggaacagcaaggcggtttgcctcccattacaaaaaagagctgtatgcacccgcggtccccctcctggatttgctgaaaagcactctgctcctggtgctgtctacgctggtgggccttatcttctattatctgggcttgagcgaggccaatatcatcacagtctatatcctgggggtgatgctgacctctatcttcacaaagagcgcggtttgcagctttctgaactcggttgtgggcgtcttggcgtttaacttcttttttacggagccaagattttcactgcatatctacgccagcgactatatggtcacatttttggtcatgtttctggcatcccttcttacaggctctctggccgccaagctaaaatctctggcgaagcactcagcccagctggcatggcggaccaagcttttgtttgaaacgaatcaggaattgcagaaggccggaacccaggacgagatcctttctgtcaccgcacggcagctgctgaagatttttcagcgcgatattgtcacctatcggtcagatcagggacagctggacgcgccgaagatctttccggttgatgatgcgttttccgaaagcaaatactccgccgcatcggagcatcaggcggcccagtgggttctgaccaacaacaagcgggcgggcgccgggacggagacgttttcggatgcgtgctgcacatatctggccgtccggaccgcagaacaggtatatggggtcataggcgtcgcggcctctggcgaggagatggattcctttgaaggcggactgctcctctcgatcctgggggagtgcgccctcgctatggaaaaccagaaaaacctggaggagaaagaggcggctgcggtcctggccaagaacgagcagctgcgggccaatctgctccgctcgatttcccacgacctgcgcacaccgctcacctccatctccggaaatgccagcaaccttctctccaacggagatatgtttgacgcaaagaccaagcatcagatgtatgtggatatttatgacgacgccatgtggctcatcaatctggtggagaatctattatccgtcagccgcctggagggagggcagatgaatctgcacctgtccacagagctgataggtgaagtggtggctgaggcgctgcggcacatcaaccgcagaagcgcggagcaccatctgcatatccagagcggcgacgagtacctgctggcgcagatggacgcgcatttgatcgtgcaggtcatcatcaatatcgtggacaatgcgatcaagtacacgccgcctggctctgacattgagattagctgggagcggcaggggcggttcgccgcactgtcggttgctgacaacggcccgggcattcctgactcggcaaaaccccgcgtttttgacatgttctacagcgcctcgaaccggattgccgacagccgtcgcagcatggggctggggctggcgctgtgcaagtctatcatcacggcccatggcggggagatcacggtggctgaccacgcgccccatgggacagtttttacgtttaccataccaattgaggaggttgaattgcatgaataaacccttgattttggtcgtggaggacgatgcgcctgtccgcagtctgatcacaacgactctgcgggcgcacgattaccgttttctctctgcggccaacggggaatccgctattctggaagccagttcgcacaatccggacatcatgctgttggatttgggactgccggatctggatggcgtagaggtgattcaccgtgtccgcacctggtcgaatctgccgattattgtgattagcgcccgcagcgaggacacggataagattgaggcgctggatgccggggcagatgactatctgaccaagccgttctccgtggaggaactgttggcccgtctgcgggtaacccagcgcaggctggctaccctgcaggccggagtggtgaacgaaggcgctgtattcaccaacggcaggctgaaggtggattatgctgcggggtgcgcgtttctgggcgaagaggaactgcatctgacgcccagtgagtacaagctgctatgcctgctgtgcaagaatgtgggcaaagtgttgacgcacaccttcatcgcccagcagatctggggcaggagttgggaaaacgatgtggcatctctccgggtctatatggccaccctgcgcaagaagttggaacgggatccggattctccgcaatatattcagacgcacattggagtagggtaccggatgctaaaggtggagtaacagcggatgcattccaatttcagtgaaaagatcgttttattcttcatgtgatgtgtgatgcattttgcggcacttgaaatactggattccatgggcataaatgagtcgagattgaaaaaaattgcctggacgactgtttgacacctatttgtaaataacccggagctgttgcggtgcaacggttccgggtacttctcctcaatgtgccgaaatttgtgcaactccacggaaccccttgtgctccaatgagtttctctttgacggactgagaactccaactttgcagaccattgcctcgaatgcagctgggcgcaccaaggaccgccgaaaattaaaaattttcggcggtccttgtctgcggctatgaaaaacggcccactgacaaattggagctgcgggggatgtcccatccgacagtgtgacaaaggcgaaagagacagccccggcgttcatgaggcagaggcgtcccggcagcggtctttaccgcaggtacagggcattccggctgatgagaaacgtaagagcggttgtttctgctgcctgtctggcctatccggcgtgatggggaaattggggttccaagtttttaagagccgacaaatcaactgggaggcgtatgcgcagaaactggaggctctgtgagaaggaggaagcctgtcccgaaaggggcaggcttcctttgctgtgagatggatactattgagagcggttaaagaggataaaaataaagtttatacggggccccatggtacaaccaagtaaaaaggcggccaaaacacgatgaagggactgtatgaactgttgtcatactgccggccctatcaaaggaccgcatacttgcgtggagtgattggcacggtattcccgcggtgtcataccagagagaacattgagctgcttatggaagtaaattgcgctgtccaacccgcagcttgaaaagaaccacacatgtgtctattcagaaggaaaaaccattcaacgttatgatgccaatatggaataaatttgcccagctacaaattgttgaatataaccttgattagctgcgcagggaaaagccgcagtaccgcgcggagcggttttttcgcaataggcacctagcgatattgtgtgttcgatgattattgatcgtcttcctgcagaaaaacaaggagagcagtctgggggttatctgttcttaaaaatgcttcctgccgtatctgcagtcaagagcgcatctgcaatttctgctttcggtgcgtttttgggtaccgactgaacaatcgtgcagaagggaatcagcttgccgtggagaattctgtgcagctcaggaataagggcatagcatttccggatgctgtgagtcaccgctagaatgccgcgctcaaaaccgacgccggatggatgggtgctgacctcaatgatgttgtccgtggcagatgtgcagatcttgcgttctcctgcgaatgttgccgcatagccgttctccggcagagggtggccaaccatatatccgcgatggccggaggccccccgacgcggctgttgcttctcgagtgcaggcaagccccggtttcaaaccatgtcaccattgcgtcacccattcctgcgacctaaaatcttgcgggaggagggcagatcatgcagggatctaccataacaatatcagggcttgcatctaaaaacagataggcgtcaaacacaccccggtcatcatacatcgcgctgagagaagagcggggagtctgctgagcacacctgaaatctggcatcttcggaaagccagagcaggcagaaaacggaaagtctttctgcctgttctgaatactggagttacttcttgtagtaggtgggtcggcccttctcgtcgtggtccttgtcgaaggtgggataggcgccgccgttgaagccgttgtagcccaggggattgcggaagcccagggggttcttgcccacaggatgggtctccagcagctccttgatcagctcactgtagccctccacaacggcctccaccagcagcttgtcgcccttctccttggtggccttggtggggttgccgatgacgccgtaatccaggtcgtccttctccagcagcgcgaaggtgccctcagcgccgtagaactgccagcggtgagaggcctcgccgggagccatcttccacttggggtccaccaggggcgtgccgccgccgtcgatggccaggtccatgtggaccaggtcgccgtacagggacagcgccatggaggtctccgcctcgtcggcgtgccacatgaagtcctccagcacgttcttgttgtcccgcaggaagtcataccaggtggaagccagaacgaagtagccctccgctgagcgacggttctgcaggctggcagggccgttgcccgcgaggcggcggacctgctgtccattcagtattatgtccgggacatcgaagaagagatagccaagcgcatgaagcagccggtcaaggagatcagcgaggtggaaaaggatgctgagagccgcttcgatgtcttcggcaacattctggcccaggtgttggcactgagtcctctccataagggggtattggagtgcccgcccgatttggcagagcgactccgaaggcgttcctctctggagatggtcacgacatcactttgccaacaaggggccggacacagactgcgcggtgctgctataaacgattggttatcccaaagcacagccctgtccaccaatttgggtggacagggctgtgccgtgcatgaaatggcaggttcagaattgaaaagtcgctgtgtctcttgattggcctccgccgcggcaatgaactcccggaatacaagggggcctgcctacggtaggaacaggggcaggggcctattggctccacatcgggctggatgtccgggtccggcagttctgcttccggtgccgggtgggcttttccattcagaacccgatgtacgcataaaaggcccgggccggttgttgcccgcctctgatgacaaatactgccccgtgccgccagggggccctggtgcccaaggccggggccagacatgggccagacttctggagggcgacattcaccccgccaccggcagccgacccggggaggccgccgcaattcccgcccccgggccgaatactgtgctgcggatcagacggagaacaacaggtcggagtaggtggggaaaggccagcggtcagagctggtgagggtctccagctgatcggcagcccgccgggcggtatccatatcggggatcaacacatcatggctgtatcgcatagcttccgcagcgtccgcgggaattgcagacaggtccgtctccagcttgtcggaggcggccatcagggcatccgtcaagctgccgatctggcaggcagtgctgacctcatactggcagcaggcacccaggtcctttttggtaccggcccggctgcacaggtccccggcaaaggcggagacggcgggtaggatttggcggcggatcatgtccgtcatggtccgtgcctcgatacagatgaccgtagagtagttctcaatgtggatctccgcccgggcctcgatctcctccttggtgtagatgccgtgcttgacaaacagatccacgtttttgggagcggtgtacatgggcagagcatcagcggtggaggtcaggttggagaggccacgcttcccggcctcctccagccaggcctcgtcatagccgttgccgttgaagatgatccgctgatgctcggtgaatacccggcggatcagcttctccaggtcggcctggaagtcccgggatacctccagctcgtccgcaaactgttccagttcctcggccatgatggtgttcagggtgatgtttggaccggagatggactgggaggagcccagcatccggaactcgaacttgttgccggtaaaggccatgggggaggtgcggttccgatccgtgttatcctgggggatagcgggcagggagtccacgtcgatcttcagcgtccgcttgccggtgctctggaaatccgtgtcgttgatgatggagtccaccacagcggagagctcgtctcccaggaagatggagagcacggcgggcggtgcctcctgggcgcccaaccggtggtcgttgccggggaaggccaccgtggcccggagaaagtcctggtagtcgtccacacctttgacgaaggccgccaaaaacagcaggaactgggcattctgccggggggtggagccgggcttgaacaggttcttgcccgtgtcggtggagagggaccagttgtcatgcttgccggagccgttgacgcccgcgaagggcttctcatggagcaggcacaccagtccgtggcggtcggccaccttcttcatcatttccatggccagctggttctggtcgcaggcggagttggcatcggagaacaccggcgccatctcatgctgagcaggggctacctcgttgtgcttggtcttagacaggacgccgagagcccagagcgtctcatccagatccttcatatacgcggccactctggggcggatggcaccgaagtaatggtcctccagctcctgccccctggggggctttgcgccgaacagggtccggccgcacattcgcaagtcctcccgcttctcatagagggccttgtcaatcagaaaatactcctgctccggccctacctgggcagtgacccgcttcgtctctgtgtcgccgaagagccggaggatgcggaccgcctggcggctgacctcgtccatggaccgcagaagaggcgtcttcttgtccagggcttcgccggagtaggagcagaagacggtggggatgcacaggctgccctccttgatgaaggcaaaggaggtgggatcccaggcggtgtagccccgggcctcaaaggtggcccgcagaccgccggaggggaaggaggaggcatccggttcaccccggatcagctccttgccggagaattccatcatgatctttccgccgcccacaggggcgatgaagctgtcgtgcttctccgccgtgacgccggtcatgggctggaaccagtgggtgaaatgggtggcgcctttttccacggcccactgcttcatggcctcagcgatctcattggcggtggagaggtccaggggcgtcccctccgtcacgcacttcttccaggcgctgtaagacgccgaggagagacgctccttcatagtgccttcgttaaataccagactcccaaacagctccggcaatttcttcgtctcacacatcacacaaaacctcctgtctcaaattcgttctgtatcaaaaaggaatgcggagagctttctcacattccgctctgaccgtagttggagaggacccgggcggagggatcgtccacgtcgcagccctcccaggaccggttgggcatccagaagtcccggatcatccgggcctggccggggtaacactgctcaaagatctcccggtacagcaggctctccttggtgaagggcggacagtagtcatactgtttgcgtcgggtctcaaactcagaatccgtgtacttctcctccgcgtaagccttcaggtcgtccaccatggagtggcccactgcgtcggagaaggcggccttctgccgccagaggatgctgtccggcagcaggcggtccttttcaaacgcgtggcgcagcaggtacttgcccatgccataggtgttcattttcagcgccggatccaccgccatgacgtatttcacgaagtccaggtcgccgaaggggacccgggcctccagagagttgacggagatgcaccggtccgcccgcagcacatcgtacatgtgcagctcatccacccgctttttggactcctgctggaaggctccggcgctgggggcaaagtctgtgtacttgtagccgaacagctcatcgctgatctcgccggtcagcagcacccggatgtccgtcttttcgtggatggccttgcagcagagatacatgcccatgctggcccggatggtggtgatgtcccaggtgcccagggcggcgatgacgacgggcagggccgccagaacctccttccgggtcatatagacctccgtgtgatcggcgccgatgaactccgccgcctcccgggcgtacttcaggtcgatggcatccgtgtccatgccgatggcgaaggtacggatcttcttccccagaattacggagctgatggcgcacaccagggaggagtccagcccgccggagagcaggaagcccaggggagcgtccgcgtccagccgtttatccaccgccgcgatcagcttgttgcggatgttgcggcagacggtctccaagtcatcgggggagtactgcgtgacggtggtgagatccgcatagcggacaaattttccgtccgcgtaatagtgtcccggcgggaaggggcggatccccttacacaaccccaccaggtttttcggttcgctggcaaagacgatggcgccggagcggtcatagccgtagtacaggggccggatgccgatgggatcccgggctgcgatgagctcatcccgcttggaatcgtagatgatgagggcgaactccgcgtccagcttggcgaacatctccaggccgtactcccggtacagaggaagcaggatctcacagtcgctgccgctgcggaaggagtagcctttttccgtcagctgccgcttcagggggcggaagccgtagatctcgccgttgcagaccacatagtccccgtccagctcaaagggctgcatccccgcctccgtcaggcccatgatggccagccggtgaaagcacagccagccggacggcgtctcgaggatctgagacatgtccggtccccgggaccgggttcggtcaaagaagggcagaagttcctccttggtgtaggtctttttggaaaaacccataattgcgcacatagatagaagcacctccgaaataaaaaagatcgcagctccgtcctgaaatttcaggacgaatagctgcgatccgcggtgccacctgacttgccccctgatcggggacctctttgactaggctccaacaagcccgcgtgaggtaacggtcacgactcgtttcacttactggcggtctcccgcgttcagatcacagctacggagtgttcttcccgcggattctttggtacggggttctcaccatcccccgctcactggcccggaacatccgcggtacttttctccatcaacgcctttgctgatgttaaaattatggtctaaagattaccactggggatatccgctgtcaatgtgggaatatcccaaaacccagctgaaaatttcctgaaatttctccatccttgtgtcagggggatgtcccatctacccaatggagcgtaccagattcgtgtagccggtcagataccggtccacctccgcagcggcggagcgcccttcggcgatggcccacaccaccagggattggccccggcgcatatcgccagcggcgaacaccttgtccgcattggcagcatagctccccggcgctgtgcggaccgtcctgtccgcctccacaccgaaggcctcgcacacgccccgctcacacccggcaaagccggtggcgccgatcaacagctggcagggcagggtatccccctccgtggtgaccacaccggtcagggaaccgctttcccccgccaccaggctctggacctggacgccgaaccgccggggatcctggcccgtaacggccagcgcctcttcgtgggcgtaatccagcggcaggcttcccgcagcgtccaggtaatccgtccggggacggcgcaccagctgggtcacggagcggcagccttgccgcagggcggtggccacacagtcgctggcggtatcgccagtgccgatgataaccacatccagcccggaggcggagggaaccgccgcctccgccttgccgaactgagcccgctccacagcagccttcaggtactcggtgccgtagcatacgccggagatgccggtggtgtccagtcccaagggccggggtgctccggccccgcagcagaggatcaccgcgtcgtactccgccagcagccgctttgccacggcaccctctgaggcgtccacaccgcagacgaaggtgacgccctcctcggtcatcaggtcgatgcgccgccggaccacagatttgggcagcttcatattggggatgccgtacatcagcagaccgccggggtgctccgcccgctcgatgacggtgaccatgtggccccggcggttcagttggtccgctgccgccaggcccgccgggcccgagcctaccacgcagaccttcttccccgaccactggggcggccggcgtgggcggagcttcccggcgccaaaggccgcttcgatgatgctcaactcattgtcccggaccgtaatggggtccccatagatgccgcagatgcaggcgttttcgcaggggcggggcacacgcggccggtgaactccggaaagctgttgaccttcagcagccggctgagggcgtggccccagttgccggagaggatcatgtcgttccactcggggatcaggttgtgcaggggacagccaaaggcctttccctcatatatcatccccgcctggcagaaggggacgccgcagttcatgcaccgggcgccctgctggcgccggatctcctccggcaggggaaggtggaactcctcccagtcccggacccgctccgccgcgggccggcggccatcctcccggcgggtatattccaaaaagccggtgggttttcccatgttgtccagcctcctctcaagctctggtattggcgtagaacgcctcgatctccgcctgctgacgggtcatgcctttctcctcgtactgggcgatggaccggagcatccggtcgtagtcccggggcatgaccttcttgaagcaggggacgtaggagtggaaggccgccaggatcttcttcccccgggggagccggtggcggccacatgggcctcaatgagggagcggagctcggcgatgtcgtgaggctccgtcagggtgtccgtcatcacctggtccttgttgaggcgcatatagaggtcgtgcttttcgtccagcacataggcgatgccgccggacatcccggctgcgaagttctttcccgtggggccgaggatcacgcagcggccgccggtcatgtactcgcagccatggtcccccacgccctccaccacggcgatggcgccggagttgcggacgcagaaccgctcgccggccatcccgttgatgaacgcctggccggaggtggcgccgtacagagccacgttgcccacgatgatgttctcgccggggtcgaaggtgctgtccttgggtggatagagtaccagcttgccgccggagaggcccttgcccagcccatcgttgcagtcgccctccagctccagggtcagtcctttggggatgaaggcgccgaaggactggcctccgccgccatggcaggtgatgacataactgtcatccggcagggagtccccgcactgccgggtgatctcggcgccgaacagcgtgccgaaggcccggtccgtggaggagacggtgagctccaaccggccggtccgcttccccttcagcgtcttgcccagtttggccagcagcacgctctcatccagggtccgctccagatgaaagtcgtaaacatctccgggattgaagtgggacggcccgccgctccagggattttccagcaggctgcggaggtccagggtctccgcccggtgggtcaccagcttctcccggacccgcagtaggtcactgcggcccaccagttcatccacggtgcggatgcccagggccgccatatactcccgcagctcctgggccacgaattccatgaagttcaccacgtactccggcttgccggagaagcgggaccggagctggggattctgggtggcaatgcccgccgggcaggtgtccaggttgcacacccgcatcatgcagcagcctagggccaccaggggcgcggtggcaaagccgaattcctccgcccccagcatacaggcgatggccacatcccgcccggtcatcagcttgccgtcggcctccagggccacctggctccgcagaccgttggcgatcagggcttggtgggcctccgccacgcccagctcccagggcaggcccgccccgtggatggagctgcggggcgcggcgccggtgccgccgtcatggccggagatcagcaccacctgggcaccggccttggccacgccggcggcgatggtgccaacccccgcctcgctgaccagcttcacgctgatccgggcccggcggttggcgtttttcaggtcatagatcagctgggccaggtcctcgatagagtagatgtcgtggtgaggcggcggagagatcagtgtcacgccgggggtggagcaccgggtcctggcaatccagggatagacctttttcccgggcagatggccgccctcgccgggcttggcaccctgagccatcttgatctggatctcctgggcgctggtgaggtaggcgctggtaacgccgaaccggccggaggctacctgcttgatggcggagcaccgctcatcgcgcaggcgcgccgcgtcctcgccgccctcgccggagttggacttgccgccgatgcggttcatggcgatggccaggcactcgtgggcctcctgggagatggagccgtagctcatggcgccggttttgaatcgcttgacaatggacgccacaggctccacctcgtcgatggagatgccgccgctctcatcgaactggaagtccagcagcccccgcagggtatggggcttggcaggctcgtccaccagggcggaatactccttgaaggtctcgtagctgccctcccggacggccttctgcagcagcaggatggtccgggggttgtacatgtggtcctccttgtccgggccggaccgcagcttgtggatgccggtggagtccagcgtggagtcgtagcccaggcccaggggatcgaaggcctggctgtggttccactccacgccctcctcgatctctgccaggccgataccctccacccggctgactgtgttggtgaagtacttgtccaccacgtcccggttgatgcccaggcactcgaagatctgggcggactggtaggactggatggtggagatgcccattttggaggcgatcttcacgatgccgtggaggatggcgctgttgtagtcgttgacggccgcagtgggatccttatccagcatccccagggtcaccagctcctctacgcactcctgggccagataggggttgatggcctgggcgccgtagcccaggagggtggcgaagtggtggacgtcccggggctcggcgctctccaggatcatggagactgcggtgcgctttttcgtccgcaccagatactgctccaaggcggacaccgccagcagggaggggatggctacatggttctcgtccaccccccggtctgacaggatcaggatgttggtgccattcttgtaggcccggtccacgttgacgaacagccggtccagggcattggccaagggagagcccttgtagtacagcagggagatggtctccacatggaagccaggccggtccatgtagcggatcttcatcagatccacggaggtgaggatggggttgtggatctggaggactgtgcagttctccgctctttcctccagcagattgccgccggagcccacatacaccgtggtgtcggtgacgatctcctcgcggatggcgtccatgggcgggttggtcacctgggcgaagagctgcttgaagtagctgaacaggggctggtgcttttccgacagcaccgccagcggtgtgtccacgcccatggcggaggtgggctccgccccatcccgggccatggggaggatggcgtccttcacctcctcataggtgtagccgaaggccttgtacagccggtcccgccgctcctgggaggaccgctccacacgccggttggggatgggaagatcccgcaggtataccaagtgggcatcgagccactcgccgtagggctgctggcgggcgtaccgctccttgacctcggcgtcgtccaccagtcgaccggcagtcaggtctgccagcagcatccgccccggctggagccgggacttcttcacgatcttctccggcgggatgtccagcacccccacctcggaggagagaatcagctgcttgtcggtagtgagataccaccgacaggggcgcaggccgttccggtccagcaccgcgcccaccgtgtccccatcggagaacacgatggccgccgggccgtcccagggctccatcatggtggcatagtagtggtagaagtcccgcttctcccggctcattttccggtcgttggcccagggttccgggatgcacatcatcaccgcctggggcagtgggatgccgttcatcatcagaaattccagggtgttgtccagcatggcggagtcggagccgctctggtctaccaccggcaggatcttgtccatgtccgcctccagtacggccgagtgcatagtctcctccctggccagcatccggtccacgttgccccggatggtgttgatttcaccgttatggaggatgtagcggttgggatgggcccgctcccagctgggggtggtgttggtggagaaccgggagtggaccagggcgatggcgctctcacaatccggctccgtcaggtccgtgtagaacttccgcagctgccccaccaggaacatgcccttgtacacgatggtccggctggagaaggagcaaatgtaggtgttcacattggattgctcgaactcccggcggaccacatacagcttccggtcaaagtccaggccacgggcgcagtctacaggccgggccacaaagcactggcagatgcagggcatacagtccagggccttccggcccagcacctccggatgggtgggcacatcccgccagcccaggaagtccagcccctccttggacgcgatgatctccagcatcttctgggcctgggcccgcttcagcgcgtctgcggggaagaagaacatgcccacgccataatcccgggggccgcccagggcgatgccctcggcggaggccgccttcaccatcagcttgtgtggcacctgaatcatcagccccacgccgtcaccggtctcgccggtggcgtctttacctgcccggtgctccagcttttccacgatcttcagggcactgtccactgtggcgtgggacggcgtgcccttcaaattcaccacggcgccgatgccgcaggcgtcgtgctcccacagggatcatagatattgtgtatgttctgcgctggtccactcattgggactgcctcccttgtcgtttcatcgtcaggcttcagcctgttgtgtaccgctccaggatcagccgggcggtctctgcaagccgcagccccgtgtccatgctgtacttctgcagaaagcggtgggcctccgcctcgctcatgaggtttacctccatcagcaccgccttggcccggcagatcagccgctcctcctcggcacttcgctggatatgaagccggggagccggggcgccgcctgcaaggactccctgggccagatccagcgaggcgaagaactccgcccgggaggaggggacggccaacttgatgaggttcctgtccccacacagctccagattcccgggagaggagatgaccagcaccggggcgatgcccgtgaggtccacggccagcatctccgcagtcatgtcccgcagccggaaaccgcagatgacgacggctccgcccagcttccgggcggctcggatggtttccgcgccgctgaagcaggagatggacggcgcgaggccgccggagcccagaatgcgggtgatctgggcgtgggctttctcagaggcaaacgccaatatgatcctgtccatggaatttgcccccctcctctctctgcggccctgtcagaagggccggcaggtcagtacgccaccagatactgttccagctcccactgggacacctgggcggcgtacgaccggcactcccgacgctttccggccagatactgctccgtcacgtgggcacctagcgcgtccgtaatgacgctgtctgcctccagggcccggacggcctcctccagagagccggggagccgctggatgccggaggcgtctcccacctcgtaaaggttgccggtgagggggcggggggcgtcatctgctgctcgatcccgtccagtcccgcggcaaggcacgccgccagggccagataggggttgcaggcgggatcagggctccgcagctccacccgggtgctgtttccccgcggtgttggaatgcggaccaaggcggagcggttgccggtggaccaggccagatggcagggggcttcgtagccgggcaccagccgcttgtagctgttcaccagtggattggtgacggcacagcatccccgtacgtgtcccagcagtcccgcgatgaactgataggccagcggggacaggtgccggggatccgcctcgtcatagaaggcatttttcccatcccgaaacagggacatatttacgtgcatgccgctgccggcggcgccgctgacgggcttgggcatgaaggtggcgtggaggccgttcttctgggccagggtcttcaccgccagcttgaaggtcatgatgttgtccgcagcccgcagggcgtcggtgtactggaggtcgatctcgtgctggccggctgccacctcgtggtggctggcctccaccgccacgcccatctgctccagattcaggcagatctcccggcgggtcccctccccatggtccagagggcccaggtcaaaatagctggcctcgtcggaagtccggatggtgggctgaccgtcttcatcggtctggaacaggaagaactccagttccgctcccacattgcaggtgaagcccagggcgtcggcacggcggagcacccgcttcagcacacctcggggatcaccggcgaaggcggtaccatcggggttgtggacgtcgcagatcagccgggccaccttgccgtactggggccgccagggcaggatggcaaaggtgtccaggtccggccagagatactggtctgattcttcaatgcggacgaatcccgcgatggagctgccatccatcataatctggttgtccagcgcccgcccgatctgagaggcggtgatggctacgtttttcagctggccgaaaatgtctgtgaactgcatacggatgaactgggcatcctcctcccggaccagccggatgatgtcctccttggtgtagtgacgcatgagcctgactcctttccgatggtgaccgtgtatggacgcggagcgcccctccgcgaaaaattttaaaaagaaaaaagagcaaaggataccgccaaagggcgcctttgctctcagtgctattattatacgaactttaaggcggtgttgtcaagacacttgggggcccggaatccccacagacggaaaatttgtgggaccgcctaaaatcgttccgccgtccccaggagctttggcgaaatcgacaaaaaatggaggaatgcgttgacagctccgacaaagctgactgcgcgcccgccatcaaacaaaggtactttggcccaccatcccacagcgccttgtttgatacacgcaacgagacatatcccactcaatggcgggggcatttcttttggcaaaagaatatgaccgacacatcagcggttatgaagatcgtcagcacaccatcttgcaggacagcgattgccccgcaggccccggatgcccggtcccctgaccacgccggacgaaaagggccgttgcccgcaggctgctctggaacggcccttccggggaaatcttccattggcagcagttatcccatgacttaggatgcccgctgccgtgcagctgggaccgcgtttcccccggcgggaaggaaacacaaaacgcgcccggaccgggaatcccggtccgggcgcggcgcgtggagacagcgcggatttacggctgccgcaggtggatctggcaggagggcagatcgtagaagggctctgccgccgtaggggtcaggccggatacggccccggtctggtacaggacggaggaggacttaaagcacaagggcagaataggcgcttgctgctgaagataggcacacaggtccgacagagctgcggcccggtcctccgctgcggcgcaggcggccaggagctgctccgtctggggatccgcccagccgccgtagttcagactgccgccggtgcccaccagggcggaaaggtcccaattcgcaggcagccgcacttcgccatagtacaggtcgaagttcccggcggccagggcggcggcatactcctcccagggcagggcctccacttggatctgaaggtcgaaatccgacagggcctgggcgatatgctccgcagcggaggccttgaaagtgttctcctgattcaccagcagggtcactgtgcgggtccggccggtgttcagtcccgctgcctccatcgctgcggcgaaatcgtcataggagtatagggactccagctccgccgggtagagcggggagacaggggagaccgggaactgggccgcccgggcgtgtccggacagcacggcgctcaccagcgtctcccggttgatgcccaggcccagggcccggcgggcggcgctgtcctgaaagggggcgcgggcggtgttgaagcccaggaactgaagcactgtggtatccgcatcctcatagctgatgttgccggtggcggtgatgggctccgtgccgatcaggtcggcagtaatcaactgcacctcgtgggaggagaactggtacagtatggcctcccggtccctggcggcggagagggcgatccgctccgcggggcgggactctccccgccaccagccgctgtgggacgccagacaggcacccgcttcatcggtggtgaaatagtaggggccggtgcccacaggggtgaggctttcctcggttccggacttgacgatggggatgtccagcagggccgggaggctggagtccgggcgggacagggttacgattaccaccccgtccccggcggagacagcggccacatgggccagccgggcgctgtaccgctgggaactcttggcccgccgcagggtggccgccgcgtccgccgccgtcaggggggacccgtcggaaaaggtgacgccgctgcggagggtgaacgtgtaggtgagggaggcggcgtcataggtgtagctctggcacagccacggctggggttccagctggcggtccaggcggaagagtccctcgtagatgagggagcccgccacctgctgcataccgtcggcacaggtcaccgggtccagcgtctggtccgggtcatagggaagggtgaacgccgcagggaggatcacctcctcctgctggtcggcgggctcctggtcccccagcaggccgttggcggactccacgggggcttccgtccagcagccggacagcagcagggtcactgcccccagcaggcacaggatctggatgcgcttggtcttggtcatggcacaggccctccggcaaagagtgtttcaaaggcagatcacggccacctgtgcgccccgggcctcgcccatcttccggtgggaccagaagaggtcggggcggcaggcggtacacaggccgcagatgtcgatatgctccggcgcgacaccggcgtggagcagccactgacggttcagacccgccaaatctacatggtatttgggccctcgacgctccagatacggccccgcctccggccccagggcagaggcccgcatggcctccggtacgtcgccgtcggtctcaaagcagcatttcccaatgcagggccccacggcagccaggatgcgttccggtctggcgcccagcaggcggaccatctcccggacggtcttctccacgattccagcggcacagccccgccatccggcgtggaccgctcccacgcacccggcgtccgggtcatggagcagaaggatgccgcagtcggcggagaacaccaccaggggcagtcctttttcagcggtgatgagggcgtcggcgtcgtagtcccggtcccggatcagacccttcccggcgtcggcggcggtgcagagccgcacatcatcccggtggacctgccgggagaggacggggtacgccgagtccatatccagggcggcgaaaaagcggcggtagttctcctccacgttctccggcgcgtccccgcgtccggggcccaggttcagggtatcccacggcgccggagacaccccgccccgccgggtggagaatccgtggcgcaccccgcccagcaggggagaggcgagccagaccagactctgttgttcatgggtgacaaatgacatggcgacctcctttgattgagcatgaaaagggacgtcaggagcgttcctggggatcgttcaccgggtccgcaaggcggcgggaaccctaccaccagatggtaccagtcagaaacagcagggcgctgacgaggaacaaggctgtaaaaggttggtgccttcggcgaataggtatccaaaggccagcagccccagggcagataccatcagacctatgccgatcagcatatttcgaatcgtgtgcagcaggcggatgctctcctgattttcacccacggaagcagctcccttctgtgaaaagaccgccccctgccctccggcaggagagaacagggagcggaagagataaaaatgaaaagacaaaggataaaagatagagtggagagtgaggagatgctcccaaaaggaaaggggctaggggaaacccatccgggtttccccagttgatctgccgaaggcagatcaagaaattccaatcattttcgccgcggcgtgtacgtggcgaaaatactttgacctaagcgccttgggcgcgttcaccagtccgcagactggtggtggggaggtcgagggggagcctgctccccctcgaaatcagttgtcgtggtactccttgcaggtgcacttcttccacttcaggccgctgccgcaggggcaggggtcgttgcggccgatcttgttgaccttgacaggctgcttcttggggcggtgccgtcgccgcccacgttttccaccatgcccttggccacccgctcccgcttgacctcctcgtccttcttcagccggacggagaacatgcggcggaccgtctcggtctggatggcggagaccatctcctcgaacatggtcagggactcctgcttgtaggcgatgaccgggtcggtgttggcataggcccgcaggcggatgccctgcttcaggtcgtccatggcgtcgatgtggtccatccagtactcgtccaccacgcgcagcatgatgacccgctccagctcccgcatgaggggcgtaccgatctccgcctccttggcctcgtaggtcttctctgcggcctccaggaagaggtcggtgaagtcctgctgggtcttgtcggcggcgtcgtcctccgtgaactggaaggtgtccttggggaagtacagcccctccaggccgcgtagcatctcccggcagccggcggcgtccagggcctgggcctcgccgaagaccatagccacgtggtcggcgatggcgttgcgggtcatggacaggatggtgtccttcaggtccttgccgtccagaacctcccggcgctgctggtagatgatctcccgctgcttgttcatgacgtcgtcgtactccagcacggacttgcgggactggaagttccgggactccacggtggtctgggcgttctcgatggccttggtcagcatcttgttctcgatggggtgtcctcgtccaggtcgaacttctccatcatgttctggatccgctcgccgccgaagaggcgcatcaggtcgtcctccagggagatatagaaccgggtctcgccggggtcgccctggcggccggcgcggccgcggagctggttgtcgatccggcgggattcgtggcgctctgtgccgatgatgaagaggccgccggcggcgcggaccttctccgcctcctccgcgatcaccgccttgtgctgggccatcttctcggcaaacagcttccgggcggccagaatctcctcgttgtctgtttcggcgtagccggtggcgtcggcaatgacctcatcggagtagccggccttcaccaggtctgcccgggccaggtactcggcgttgccgcccagcatgatatcggtgccgcggccggccatgttggtggccacggtgacggcgccgaacttgcccgcctgggccacgatctccgcttccttctcatggttcttggcgttcagcaggttgtgctggatgccctcccgggccagcaggccgctgagcagctcgttcttctcaatggacacggtacccaccagcacgggctggcccttggcgtggcagtccttgatctgctggatgaccgctcggtacttgcctgcctcggtcttgtacaccacgtcgtggtggtcgtggcgctggttgggccggttggtggggatctccacaatgtccagctcgtagatggtgccgaactcctcctgctccgtcatggcggtgccggtcatgccggacagcttgtcgtacaggcggaagtagttctggaaggtgatggtggccaaggtcttgttctcgctggccacggtgacgtgctccttagcctcgatggcctggtgcaggccgttggagtagcgccggccgaacatcagacggccggtgaactcgtccacgatgataacctcgccgtccttcaccacatagtcgatgtcccgcttcatcacgccgtgggccttgatggcctggttgatgtggtgggagagggtagcgttctccgggtcggacagattctccacgtggaagaactcctccgccttggcgatgccccgggcggtgagcatggcggtcttggccttctcatccacgatgtagtccgcgtccgcctcggcgggatcctcttcctccttgttgtccacctggacgaccgcctgcttcttcaggcgggagacgaacatctctgccatgtcatagagctgggtggacttctccccctggccggagatgatgaggggtgtccgggcctcgtcgatcaggatggagtccacctcgtccacgatggcgaaggcatgaccccgctgcaccagctccgtggagtagatgcacatgttgtcccgcagatagtcgaagcccatctcgttgttggtgccataggtgatgtccgcggcgtaagcggcctgccgctccttggtggtcaggccgtggacgatcaggcccaccttcaggcccaggaagcggtggaccttgcccatccactcactgtcgcgcttggccaggtagtcgttcaccgtgacgatgtggacgccccggccggtcagggcgttcagataggcgggcagagtggctaccagggtcttgccctcgccggtcttcatctcggcgatccggccctggtgcagcacgatgccgcccaccagctgcacccggtagggccgcatgcccagcacccggtccgcggcctcccgcacggtggcaaaagcctccggcaggatatcgtccagggtctcgccattctgcaggcgctccttgaactccgtggtcttggcccgcagggcctcgtcgctcatggccttgtattcgtcggccatggactcgatcttgtccacgatggggtagatggatttcagctcccgggagctgtaatcgccaaaaatctttttcatcagacccatgattgtgatacttcctttccgggccggtccctccggcccgccggaatggcggagcgctggagaaaggcccgttgatccatattatttataaaaggtggggcagtccccacgaaaaagcagaaatagcataccacaatcgcaggtggaatgcaaagaaaaaacaacttttgtaaaaaagttcataaatagcggcccatgtccggcagaagccatgatttttcgacaggacgcggcggggaaatcagcgaaaagaaacaaacgcttcccgaccgggcaatcgattgcccagtcataggagctccggatccagctcctcgtccagcagcatccggatgcggctgaggaccgtgccctcgccggtggaggcgtcgtagtccacgcttaccagccgggcgcccggcagcttgcgctggagggcggcgtactgccccttgccgaagatgtggcccggcaggcaggcgaagggctggacgcagagaatttttcggtatcccagccgggcccagcccacggcctcggcagcgatcagccacccatccgccaccgtcacccgcaggggagcatacccctccgcctgccgcttcagctccggcagcggcggcagggcatgatagcccgcctgattcaaaatcgacagcatatcccgctggatctccgccaggtacgacgccagcagccgatacacccgccgggcaggggcggagcctttcagggcgtggccgtccatgtagtacagggcgtaccaggtgatgccgcccacgccgatctcgcagtgctccgccgccagataccgctccaaattccagttgcccaggtggcagtatttcgtgtagatctcccccacgatagccaccttctggacttcacggggcacccgctccaccgcccggaattcggccgccatctcccggcagcggcgcaggatctcccggcgggtgagtcctcgattccccgccagatcctgtcccaggtcctccgtccagcggcgccagagtgcctccgccgtgccggggactgcctcgtatggccgggtctggttccgcagcagggccagcgtgtcccccacacggcagcggccagacagcggcggaccatggcggcggtgatgggcagcccggtgccccagtcgatgccccggacattgagactcagggtctccacccggccgtagcccagccggtccagcacccgccgcagcaggcggatgccgcaggagccccggcactcgtcccccgcctggccgaacagcaccccgcaccgggccgggtcgtaccgcccggaccgcagggcggacagcacctgccccgccaccaggaacaccggatagcacagctcattgtggaaatatttcagccccagctccgccagatggggatcgtcctccgtcagcagcaccggctcccattcctccgacgtaaaggcgtactgcagcagggggaaccaatcgtccagcagggaggggatcagcagcgtcttccgctctgccatcccggccacctccttttatcccagcataccggtccgcgcgggggaaagcaaggcaaaagtggttacaaaatccgccggaatccccgccgccccttgccccgcccgctcctttgtgttaaactgacaaaaaagccccacccgccgccgcggcggggaggagcaaaaaaggaggttcccccatgaagctcagcttttacggcgccgaccagtgcgtcaccggcagctgccactgtctggaggtcaacggcaggcgcatcctggtggactgcggattgcagcaggggcgggacgaggtgtccaacgacgcttttccctttgccgcgaacgacatcgacttcgtcctggtgacccacgcccacatcgaccacaccggccggatccccatgctggtgaagcagggcttccagggccggatcgtcgccacccggctgacggcggatctcatggacatcatgctccaggactccgcccacatccaggagtccgacgcggagtggaagaaccgcaaggcggagcggtccggcgccccccgggtggagcccctttacaccatcgaggacgcccagcgggtgagccagtacatgaccacctgcgagtacaaccagcccctggacctgtgcgagggcgtccgggtggagttcgtggacgcgggccatctgctgggctccgcctccatcctcgtcaccgccacggagggcggcatcaccaaacagatcgtcttttccggcgacatcggcaatgtggaccagcccatcatccgggaccccacctacctcaccggcgcggactacgtggtgatggagtccacctacggcgaccgcaaccacacggaggtgtggagctacaccgacgatctggcgaagatcatcgacgagaccatcgccaagggcggcaacgtggtgatcccctccttcgccgtgggccgcacccaggagctgctgtacttcatccgggagatcaaggacaaggggatggtgaagagcgacccggacttccccgtgtacatcgactcccccctggccaagaaggccaccaccatcttcaccggcgacctgcggggctatctggatgaggcggcgctggagctggtgcaggacggcacccacatgttcaacttcaccaacctgcgcatgacggagaccagcgaggagtccaagatgctgaacatggaccccacccccaaggtcatcatctccgcctccggcatgtgcgacgcgggccgcatccgccaccacctgaagcacaacctctggcggccggagtgcaccgtggtgttcgtgggctaccagggggagggcaccctgggccgcgccctgctggagggtgtgaagagcgtgaagctcttcggcgaggagatcgccgtccatgcgcagatcgtgaacttccagggtctctcctcccacgcggaccggaaccacctgctctcctggatccaggccatccaggcccccaagccccagcacgtgttcgtggtccacggggaccgggaggtggcgcccttcttcgccaagaccatccagggcctgggcttcaccgcccacgcgccccagtacacggaggtgtacgacctgatcgccgacaaggtgaccgagcccggctacctgcctgagcggaaggccaggaccaccggcggtatgcgggccagcgcggcctacgagcggctggtggccgtgggcaacatgcttatggagagcatcaagcgcagccgcgggcgggacaacaagtccctggcccggttcgcggaccagctgcggcagctgctggagaagtgggagagctaaggcagctcccttgccagagagaaggcggcctggaacgcggcctccagctccatgctgtggagctgcgccgccgcatcctcgtatttttcgacggtgttccagctgtcatccggaagcaggtcccggagccgcagggacaggcgggcggtcaggcgggagacttcccggtactccggggaggggagataggaggggaggagctcctccttggcataggcatataaaatttccattgcatccgacatagcgatcaccatagcacccattttgtacatatcattatatacacccatattgtgcgtgtcaagggatttgagagtttttatgataaaatttgcggagagactgcgcgaactgcggagagaaaagaaagtgacccagtcaaagatggccgatttcctcggtatcaagctgaggtcttaccagaactatgagggcggctctcgccggccggattacgagggactggtggccctggcggattacttcgacgtgaccacagattatctgctggggcggagcgacgtgcgggggtaacatgggatgggccgccgtccggcggccacgggggattctgctcccgcagggggctggtccagcgggatgcaccccccattgtcgtcgtcgcaaagtccgctcagctccgtttccgcctgcggcgaaaactgcgcctgctcccttgctcctcctctccccaccgcgcggggcgcggcgggggcccctttcggtcttgccaaaagagaaacgggccgtgcacggtccaaaagaaaagaccgcttagacgcgctccggcgcgttcgtgcctccgcgcgacgggggtcggcggatcggtgcaagcgccgattttggcctgccttcgggcacgctatcatcttctgcgatttctgggactgccgtcccgtggcggatggtgcggaggtcgtcggggtggttatcgcattgtctctgcttctcttttcgctgccgctggccgtcccgcgcgggaactggtgcaacgggcggatgtggacatccgcccgaaagcataaacccctacgaccacccgggtagcgcgtagcgaagcggaacgcgcggaaagaggagccggtcaaatgcgtccttgcaccccgacccaagacgcacccgcgccgcgggaatccgccatcaagcctgtaccgcaccccgccgcgcccgtcggggagccatcgcagacccgcaggcaccatctcacgccgacccccgtacagcaactttgcaccagaggtgcaaagttgcgaccaaagcgcctttttctcttacaccgggcgcggcgcgttctctttttgggtaagaccaaaaagagaatggggggcgcatctgcctagccatcagcatggctgaaattccagcgtccaatgggacgcaccccccggaggtatctatggatcgacttcatgaaaaccgcatctacaccggcacggtggaatcctactccagcgagggtttgggcatcgtccgcctggacggcgccgtggtgttcgtccctcaggccgtccggggggaaaccatcgacctgaaaatcaccaaggtgatgaagaccgccgccgcaggggagatcgtgaagatccacaagccctctcccgaccgggcccagcccgagtgccccgattacggccggtgcggcgggtgcgacttccagcacctgacgtaccccgaggagctgtgggccaagcgccagcgggtccaggacgccctgacccgcctggggggcgcagacatccgggtggaagagatcctgggggcgaagaaccccctccactaccgcaacaagagccagtaccccgtgggcgcggacggcgccatcggcttctaccgggcccggtcccatcaggtggtgccggtgaagcggtgcttgatccagcccgaggcggcggacaaaaccgccgcggcggtgggggagtggatgcggcgctacaaggttcccgcctacgacgaggccaccggaaagggactggtgcgccatgtgtacgtccgggtgaaccggaagggcgagagcctttgctgcgtggtaatcaacggcaggcaggccccccgggagccggagctggccgcctatgtctgcgccgccgtgccccacaccgcgggagtgctggtgaacagcaacacgaagcggggcaacgtgattctgggggagaagtaccgcaccctctgggggcgggactatctgatggacaccctctgcggcctggagttcaagttgtcggtgccctccttttaccaggtgaaccgagatcaggcggaagcgttgtacggcaaggccctggattatgccggcctgacggggcgggagacggtgctggacctgtactgcggcatcggcaccattacgctgtgcctggcgaagcgggccggacgggtcatcggcgcggagatcgtgccggcggccatccgggacgccaaagagaacgccgcccggaaccacattgaaaacgcggaattcttctgcggcgacgcggctgagacagccgcacggctggaggcggagggcctgcggccggacgtcatcaccgtggacccgccccggaaagggctggcgccggaggtgatcggctccatcgcggccatggggccggagcgggtggtgtatgtctcctgcgaccccgccacgctgggccgggacgtgaagcggttcggagagctgggttaccgggccgtccgggcctgtgcagtggacatgtttcccgccacacggcatgttgagagcgtggtgctgctggagaggagttgaccaaaatggcagtttcaaaattccggatttatgactactggaaagacaaagccatcacgaaaaaatttgaaatcaagccggtgtccgcgtgcacgaaggaggacgacgcactttccataacagaatttcctgatgagattttttgctgggcttgtcagatgccgccgtatcaacaggggacacatcggacactcagcggactttggaatggagacacacttttacagcggtcccatattttggaaaagtccctgaatggagaggataaacccgagaattattttctgctgtgtccgcaatgtcacgcggaatctccggatacgacggacgcgaagctctttttcgcgtgggtccggtataagcggacgcatgagaactattccatggtgcttcggagggatatgaaaaaggcggcggagattctgggagtggaccagaaccttgtggaggagcgatttgccgcgctgcggctgacccggctggaagaggatgcgtatattcgagactatattgtcaaaaactgtgcgatgcatggcagctttcttgcgccgctctcccgcatgatgatcctgcaaaaatggattctggacccggaggaacagaaaaagtttgccgcctggcggaggacgctgcctgaagaagagactggtgagaaggagccaacataaatatctcaaaagagatcattccgcaaggactgaagaataaaacagttgtcaaacacagtttgagggtgtatgataaatcacaaatcagggcggtcactgccagagaaccgaaacaggaggagtattatgaacaaaacggcaagcatggtcttgaagatcatcggcgccagcctggcattcgcagcggttatctgcctgctgatcggcggctggcatgacctcagcgtgggatacagcggtatgaagaagcggctggcccggaaattcggctccgagtacgacgactacgccgacgaagagctctacgagtaatccagagcataaaaaggaccccatccagatggatggggcccttttctgcgttttttccgccacagggcaacaaaaaacggctggaagaaatccccaaccgcaacgaaattccccttgacagaggaaaaaaaccatggtaaaataagacgcttatatgatggcagaggatattccgccattttttatcgttgagataacgatagcatatttcccagaacaatgcaagagcgggatgcaggaattttaacaacgataccgtgcgtatcattcctggccgcgccacccgaaaaaccacgcgcccggcaggacagggcggggcgcacagaagaaaggtgaatgagaagatggccaaagacaagtactacggaaagacccttcgtaagaacttcgccaggcacgaggaagtcatgcccatgcccaaccttctggagatccagaagaagtcttaccaggagtttttggacaccggcctccgggaggtgttcaacgacgtgggcgcgatcacggactatcagggcaacctggagctgaccttcatcgactacaagatggatgaggcgcccaagtacgacgtggaggagtgcaaggcccgggatgccacctacgccgcgccgctgaaggtgaaggtccgccttcggaacaaggagaccgaggagatcaaggagcaggagatcttcatgggcgacttcccgctgatgacccactccggcacctttgttatcaacggcgccgagcgcgtcgtggtttcccagatcgtccggtcccccggtgtgtactacggcaaggagacggacatcaagaccgacctgcccatcctcacctccactgtcatccccaaccggggcgcctggctggagtatgagaccgacgccaacgaggtcttctgggtccgcatcgacaagaaccgcaagctccccatcacctgcctgatccgggccctgggcctgaagacggaccaggagatcctggaccagttcggcgacgatccccgcatcgtcaccaccctggagaaggacccctgcaagaactacgaggacgccatgctggagatctaccggcgcctgcgtcccggcgagccccccacggtggaggccagcgagaccctgatccacaacctgttcttcgacccccggcgctacgacctgtccaccgtgggccggtacaagttcaacaagaagctgtccctgtggcagcgcatccccggctacaagctggtctatcccgtggcagatcctgccaccggtgagctcctgtttgatgagggccatctgctgaccaaggacgatgcccgcctgctggatacggtcggcgtgggagaggtcaccatcgacgtggagggagcgcccctgcgggtcatgtccaataagatgtgcgacctgagccattatgtggacttcgatcccctggccgagtgcggtatcaaggagcgggtgcgcttcgacgtgctgcaggagctgctgggccagtacagcggcgaggagctgaaggaccagatccgcctgcaccgggccgatctggtgcccaagcatatcatcattgatgatatcctcacctccatcaactatatgaacggcctggcccggggcatctccgtgaaggatgacatcgaccacctgggcaaccgccgcctgcgctgcgtgggcgagctgctgcagaaccagttccgcatcggcttttcccggatggagcgggtaatccgggagcgcatgaccatccaggacctggatgtggtcaccccccagagcctcatcaacatccgccccgtcactgccgccatcaaggagttcttcggctccagcccctgagccagttcatggatcagaccaaccccctggcggagctgacccacaagcggcgtctttccgccctgggccccggcggcctctcccgcgagcgtgccagcatggaggtccgcgacgtccattacagccattacggccgcatgtgccccatcgagacccctgaaggtcccaacatcggcctgatctcttatctcgccacctatgcccggatcaatgagtacggctttattgaggcgccctaccgggcggtggacaaggagaccttccacgtctccgacgagattgtctatatgaccgccgacgaggaggacaactacatcgtcggccaggctgctgagcctctggacgagaacggctgcctcatcaacgcccgtatcacggcccggcaccgggacgagatcgtggaggtggacaaggagcgggtggactacatcgatgtgtccccccggatgatggtctccatcgcgacggccatgatccccttcctgcccaacgacgacgccaaccgcgccctgatgggcgccaacatgcagcgtcaggccgtgcctctgctgcgtccccacgcgcccattgtgggcaccggcatggagcacaagatctgcatcgactctgagatcgctgtcctggcggagggcgacggcgtggtgacctctgtggacgcccgccacatcaccgtcaagtacgacagcggcgaggtcaaggactacaagctgaccaagttcctccggtccaaccacggcacctgcatcaaccagcggcccatcgtggaggtgggcgagcgggttcacggctggggcaccgacgagaacggccagaccgtggatcccaccgtcctggcggacggccccgccactgagcagggcgagatcgccctgggccagaacatcctggttggcttcatgacctgggagggctacaactacgaggacgccgtgctgctgaacgagcgtctggtgcgggaggacctgtatacctccatccacatcgaagagtacgagatcgacgcccgggacaccaagctgggcccggaggagatcacaagagacatccccaatgtgggcgaggacgccctgaaggatctggacgagaacggcatcatccgcatcggcgcagaggtccgttccggcgacatcctggtgggcaaggtcacgcccaagggcgagaccgacctcaccgccgaggagcggctgctgcgggccatcttcggtgagaaggcccgggaggtccgggacacctctctgaaggtcccccacggcgagagcggcatcatcgtggacgccaaggtcttcacccgggagaacggcgacgagctggggcccggcgtgaacatggtagtgcgggtgtatatcgcccagcgccggaagatccaggtgggcgacaagatggcaggccgccacggcaacaagggtgtcgtgtcccgggtcctgccgcaggaggatatgcccttcctgcccgacggcacgccgctggacatcgtgctgaaccccctgggcgtgcccagccgtatgaacatcggccaggtgctggaggtccatctgggctacgccgcccagaagctgggctggaaggtggccacccccatcttcgacggcgcgtcttacagcgacattcaggagctgctgcagcaggcgggcctggatcctgagggcaagagcgtgctgtacgatggccgcaccggtgagcccttcgacaacaaggtcaccgtgggctacgtgtacttcctgaaactgcaccatctggtggacgacaagatccacgcccgctccaccggcccgtactccctggttactcagcagccgctgggcggcaaggcccagttcggcggccagcgcttcggcgaaatggaagtctgggccctggaggcctatggcgcggcctataccctgcaggagatcctgacggtgaagtctgacgacgtcaccggccgcgtccggacctacgaggccatcgtcaagggccacaacgtgccccagcccggtgtgccggagtccttcaaggtgctggtgaaggagctgcagtccctgtgcctggacattcaggtgctggacaaggacggcaacgtcatcgaactgaaggaagacgaggacgctatggacaccttcaacctggcccggatggacgccgacgatgaccggcaccgcgccttctccgaagaggcggagttccaggattccggctttgacatcgaggacgccccggaggatgccggcgcggacatcgacgtggacttcgacgacgaatgatccaggatcgtattgttcgtcaactcaacaattctggatcatgtaaggaggaaatcgcaagatgatcgacaacaacactggcaacaacattgcctttgacgcgattaagatcggcatggcctctccggagcagatccgcgcctggtcctatggcgaggtgaaaaagccggagaccatcaactaccgcaccctgaagccggagcgggacggcctgttctgcgagcgcatcttcggacccaccaaggactgggagtgccactgcggcaagtacaagaagatccgctacaagggcaagatctgcgaccgctgcggcgtcgaagtcacccgggccaaggtccgccgggagcgcatgggccacatcgagctggccacccccgtctcccacatctggtatttcaagggcatcccctcccggatgggtctgctgctggacatcagcccccggatcctggaaaaggtgctgtatttcgccaactatatcgtcaccgaccccggtgagactccgctgaccaagaatcagatcctctccgagaaggagtaccgggattaccgtgagaagtatgaggacgacttccaggccggcatgggcgccgaagccgtgaagaagctgctccaggacgtggacctggaggccctctccgcccagctccacgcagagctgaaggatgcctccggccagaagaaggcccggatcgtcaagcggctggaggtggtggacgccttccgtctgtccggcaacaagccggagtggatggtcatcgacgtgctgcctgttatcccgccggagctgcgccccatggtgcagctggacggcggccggttcgccacgtccgacctgaacgacctgtaccgccgggtcatcaaccggaacaaccgactgaagcggctgatccagctgaacgccccagatatcatcgtccgcaatgagaagcggatgctccaggaggctgtggacgccctgatcgacaacggccgccggggccgcgccgtcaccggcgccaacaaccgggcgctgaagtccctcagcgatctgttaaagggcaagcaggggcggttccgccagaacctgctgggcaagcgcgtggactactccggccgttccgttatcgtggtcggccccgagctgaaaatctatcagtgcggcgtgcccaaggagatggccgtggagctgttccgtcccttcatcatgaaaaagctggtggaggacggcactgccaacaacatcaagtccgccaagaagatggtggacaagggcgtcaccgaggtgtgggacgctctggatgtcatcatcaaggaccaccccgtcatgctgaaccgcgctccgacgctgcaccgtctgggcatccaggccttcgagccggtgctggtggacggccgggccttgaagctgcaccccctgaactgcaccgccttcaacgcggacttcgacggcgaccagatggccattcacgtgcccctgtcggccgaggcccaggcggaggcccgcatcctgatgctctccgccaacaacctgctgcgtccccaggacggcggccctgtcaccgtgcctacccaggacatggtgctgggctcctactacctgaccatggaccgcatgggcaaggcggagaagggcgccgagaccatctggtgcgaggatgccggcgacaccaacctcaccgctcactccatcgtggacgcggatgactttgtggccgccaacgacgccctggagaaggggcagaagaaggccgcctaccgccctctccacttctacgccagcgaggaagaggccctcatggcctacaacgaccatgtgattgggccccactgccccatcggcgtgcgccgcaccatgaccgtggacggcgtcagccacaccgctgtggtagagtccacccccggccgtatcatcttcaaccagaacatccctcaggacctgggctttgtggaccggaccgatcccgcccacgtctgcgactatgaggtgaccttcacctgcggcaagaagcagctgggccagatcgtagaccgcaccatcaacaagcacggcttcaccgtggccgctgaggtgctggacgccatcaaggccaccggctacaagcactccaccctggcggccatcacggtctccatcgcggatatgaccgtgccccccaagaagtacgagctggtggcggcctccgagcagaaggtgctggacattgagaaccagtacaagatgggcttcatgaccgagcacgagcgctacaagcaggtggtgcaggtgtgggagaagaccaccaacgatgtctctgacgccctgcagaagaacctggaccgctataaccccattttcatgatggcggactccggcgcccgcggttctatgaagcagatccgccagctggctggtatgcgtggcctgatcgccaacaccgccggccgcaccatcgagatccccatcaaggcgaactaccgcgagggcctgaccgccctggagtacttcatctcctccagaggcgcccggaagggcctggccgacacggctctgcgtaccgcagactccggttacctgacccgccgcatggtggacgtctcccaggatgtcatcatccgggaggaggactgccacgtgacccacggcatcaaggtctccgagatcagcgagaacggccaggtgatcgagaagttctccgaccggctccggggccgtttcctggtgggcgatgtggtggacgccgataccggcgaggtgctgctgtccagcaccaagatgatggacgagaacgacgccaagatcctggagacccacaagtgggtccaggccaactaccgcgacggcgaccgctgcaccttcgacccggcggttgacgagcaccccaccgtcatgatccgcaccgtgctgacctgcaaggcccacagcggcgtgtgcgccaagtgctacggcatgaacctggccacccagcagcctgtgggtccgggcgaggcggtcggcatcattgccgcccagtccatcggcgaacccggcacccagctgaccatgcgtaccttccacaccggcggtctggccggcggcgacatcacccagggtcttccccgtgtcgaggaactgtttgaggcccgtaagcccaagcggatggctactctggcagagatcggcggcacggtcaagttcgaagagaccagcaagggcagcctggtgaacatcgtcatcaccgcacctgacggggacacccgcacctacgcggtgcctcacaccggcctgctggtgaaggacggcgacgtgatcgaggccggccaccagctgacctacggtgcgttgaatccccacgaggtgctgcgcatccgcggcgctgacgccgtgtacaactacctgatccaagaggtcctgcgggtgtaccgccagcagggagtggatatcaacgataagcatatcgagatcatcgtccgccagatgatgcgcaaggtccgtctggaggacgccggcgacaccaagctgctggacggctctatggtggacgtcctggagctggacgacgccaacgaggagatcgaccgccgcaacgccgccggtgagcggcaggagaacggcgagcctctgcgccacgccgtaggcacccagctgctgatgggcatcacgaaggcatctctcgccacggactccttcctgtccgccgcctccttccaggagaccaccaaggtcctgacggaggccgccatcaagggcaaggccgaccatctggtgggcctgaaggagaatgtcatcatcggcaagctgatccctgccggcacgggcctgacggcctaccacacctttgctgaggagttggttcccggcccggcgcctgttgaggccgccccggagcccattcccgcagagctgtgattcgccggacatcccgcagacacaagaccgggagagagcctgaccgcttgcggtcaggctctcttttcagatgccgggcatcgggaggcggggtgaaggagacgccccgcagcccggggctgaaacggttctgctgagaagcggatgaccaacgcccccctttatttaaaatatcaaagctcccttgttcccaggcgcactgcgccgtatccggacggcggccagaaacggcccggaaacagggagaagttctcctaagatgtctccaggtatccggcacgcccgggagatggggaaaacgtccaaaagtctgcggatcatggaaaatttttaccgaaaaatgtcttgacggatatgtttccccatggtataatccaaaaatgcgcggatattaggattctgcggattttgccatgcgtttcaggaggaatttcccgtgatctcggagcttgcttcccaggagaaggtcatcggcgtgaagcagtcccgcaaggcgatccgggaaggccgggccaagcgggtctatctcgcctgtgacgccgatcccgccatcaccgagccggtggccgccagctgtgcggaggccggcatccccgtagagacggactacacactgtcccagctgggccaggcgtgccggatcagcgtgggcgcgtccgtggtggccgtcctctccgcataaagaaatggtttttttcggaatagcttcaccgcgttccgtaaaaaataagggctgtcgtggttacacggcagcgaaattatgaaagaaaggagaaatacaccgaatgcctacttttaaccagctggtccgtaaaggaagagaacaggctacctacaagtccacttctcccgctctgcagtttggtctgaacaccctgaagaacaagaccaccgatctgccttctccccagaagagaggcgtgtgcaccgccgtgagaaccgcgacccccaagaagcccaactccgccctgcgtaagatcgcccgtgtgcgtctgaccaacggctacgaagtcaccgcttacattcccggcgtgggccactccctgcaggagcactccgtcgtgatgatccgcggtggccgtgtcaaggatctccccggtgtccgttaccacatcatccgcggtacgctggatacccagggcgtctccggccgtatgcaggctcgttccaaatacggtgccaagcggcccaagcagaagtaagtctgcgaactgagagctttgccgaataggtttatatagatggcggcctccgggccgccgggacgacctctttggcaggcatccacggaaggctgcaatacgccttttgagtacctatgagatcatagaattattatgaaggagggaagcatagtgcccagaagaggtaatgttcccaagagagagatcctgccggatcccgtttacggctccgtcctggtcacccggctgatcaatagtgtcatgctggatggcaagaagggcgtggcccagaaggtggtctacggtgccttcgaccagatcaaggagaagaccgagaaagaccccatcgaagtgttcaaccaggccatggagaatatcatgcccagcctggaagtcaaggcccgccgtgtgggcggcgccacctatcaggtccccatggaggtccgtcccgcccgccgcacgaccctgggtctgcgctggctgacggcctacgcccgttcccgcagcgagcgtaccatggctgagcgcctggccggcgaactcatggacgccgccaacaacaccggcagcgccgtgaagaagcgcgaggaagtccacaaggcagccgaggccaacaaggcgttcgcccatttccgctggtaagttaggagaaacagtatgccgagaaaaacacctcttgaaaatacccgtaatatcggcattatggctcacatcgatgcaggcaagacgacgactaccgagcgtatcctgttctacaccggcgtgaactataagatcggtgagacccatgatggcaccgccaccatggactggatggcccaggagcaggagcgcggcatcaccatcacgtccgccgccaccacctgctactggtccggttccaagaaccagttcaagcccacccggattaacatcatcgacactccgggccacgtggacttcaccgtggaggtggagcgctccctgcgcgtgctggacggctctgtcaccgtgctgtgcgccaagggcggcgtggagccccagtctgagactgtgtggcgccaggccgataactacaaggtccccggatgatctatgtcaacaagatggacatcatgggcgccgacttctacaacgtgctccgcatgattgaggagcgcctgaagtgcaacgccgtgcccatccagctccccatcggcagcgaggatacctttaaaggcatcatcgacctgatcgagatggacgcggacatctactatgacgatctgggcaaggatatgcgcgtggagcccatccccgcggacatggtggacctggcaaacgagtaccgggagaagctgatggacgccgtgtccatggtggacgagtctatcatggaggcatatctggctggcgaggaagttcccacggccaagatccgtgcggccatccgcaaggccacgatcgccaatgagatggtgcccgtcacctgcggcacgtcttaccgcaacaagggcgtgcagaagctgctggatgccatcgtggactatatgccctctcccctggacattccgcccatcaagggcgtgaaccccaagactgatgaggaggacgagcgtcctgcggacgacaacgcccccttctccgccctggcgttcaagatcatgaccgacccctatgtgggccgcctgagcttcttccgcgtctattccggccatctgaccaccggttcctccgtgctgaacagcaccaagaacgtcaaggagcgtatcggccggattctgcagatgcacgccaaccaccgggaggatatcgaggaggtcttctccggcgatatcgaggctgccgtgggtctgaagaacaccaccaccggcgacaccctgtgcgatgaaaaggcacccatcatcctggagtccatggagttccccgagcccgtcatccgcgtggccatcgagcccaagaccaaggccggccaggagaagatgaccatgggcctcatcaagctggccgaggaggatcccaccttcaagacctacacggatgaggagaccggccagaccatcatcgccggcatgggcgagctgcacctggagatcatcgtggaccgcctgctgcgcgagttcaaggtggaggccaacgtgggcgcacctcaggtcgcctacaaggagaccatcaagaaggccgtggaccaggacaccaagtatgcccgtcagtccggcggcaagggccagtacggccatgtcaagatccacgtggagcccaacgagtccggcaagggctacgagtttgtcaacgccatcgtgggcggcgccgttcccaaggagtatatcccggctgtcgacgccggtatccagggcgccatgaacgccggcgtggtggccggcttccccgtggtggatgtgaaggtcaccctgtacgacggctcctatcatgaggtggactcctctgaaatggcgttcaagatcgctggctccatggccttcaaggaggcctgccgcaaggccgatcccacgctgctggagcccatcatgaaggtcagtgtcatcgtgcccgatgagtatatgggcgatgtcatcggcgacctgaacagccgccgcggccagatcatccagctggaggcccgtcccggcgcccagcagatcgacgcctacgtgcccctggccgagatgttcggctatgccaccgatctgcgctcccgcacccagggccgcggccagtacaccatggagcccagccactacgtggagatcccgaagaatatccgggataagatcgtggagacccgcaataagccccaggcgtaaggaaaaagggattgattttccctccattatacggtaaaataagcaatgctgagaaaaaccgcattgcacccaacagattttgaaaattgacaggaggattttcaaatggctaagcagaaatttgaaagaaccaagccccatgttaacatcggcaccattggtcacgtcgaccatggcaagaccacgctgactgccgccattaccaagtggctgtctctgcagggcaaggctcagttcgaggcttatgactccatcgacaaggcccccgaggagaaggagcgcggcattaccatcaacaccgctcacgtggagtatgagaccgagaagcgtcactatgcccacgtggactgcccgggccacgccgactatatcaagaacatgattaccggcgctgcccagatggacggtgctatcctggttatcgccgcttccgacggccccatggctcagactcgtgagcacatcctgctggcccgtcaggtgggcgtgcccgccatcgtcgtgttcctgaacaagtgcgatcaggtcgacgaccccgagctgctggagctggtggagatggaggtccgtgagctgctctccaagtatgagttccccggcgacgacatccccatcatcaagggttccgctctgaacgctctgatttccgagtccagcgatcccgccgctcccgagtatgcctgcatcaaggagctgatggatgctgttgacgactatatccccacccccgaccgcaaggaggatatgcctttcctgatgcccgtcgaggacgtgttcaccatctccggccgcggcaccgtggctaccggccgtgtggagcgtggtgtcctgaagctgagcgaggaagtcgagattgttggcctgaccgacgagaagaagaagaccgtcgtcaccggcatcgagatgttccacaagctgctggactacgctgaggccggcgacaacatcggcgccctgctgcgtggcgtggaccgcaacggcatcgagcgcggccaggttctggcgaagcccggttccattcatccccacaccaagttcaagggccaggtttacgtcctgaccaaggacgagggcggccgtcacacccccttcttcaacaactatcgtcctcagttctacttccgcaccaccgacgtgaccggcgtcatcaccctgcccgagggcactgagatgtgcatgcccggcgataacgtcgagatgagcgtggagctgattacccccatcgccattgagaagggcctgcgtttcgctatccgtgagggtggccgcactgtgggttccggcgctgttaccgagatcaccgaggcctgatttttcagccaagaaaaagaactgccgcaatgcggcagttctttttttgcccgcaggccattccgaacgggctcagtcctgctccggatagaccagtgtgtcctggaatccgtctgccccggcgcagaggatatccccggccaccggctgcccctcgcagacgtagaggttggcctggacaccctccggccgtccgggatagttggtgacggtgtaggtgtaccgggccacttgcttgccgcagcacgcagaaaggtcgaagccctgggaatcctgcagctcgttgtaggtgaggtagggctcctccagtttctccggcagcagaaactgcagcgtctccaccggttcctcctccacctgccagcccatggactccagataggcgatgcggtcggcattgccggtcagctgccaagctgccgcgtcctgaccgccaccggagcggcccaccagcagcaggacggcggccgccaggatgccggccaggatcacagccacaacggcctttgtcttcttggaaacccgcgcggtccaaatcagcatatcgatccctcctgcatcttcctattcatttttttccggatttatgataagatgaagcagaacaagccgtcggaagagagtctgccgtgttcgtcccgggggaagagaagcggtaaaaagaggcagaggtcagcaaggaggaggccggcatggagaaagcgcgtctggacaagatcatcgccggggaggggacatactcccggcgggaagtgaggctcctggtccgccagggccgggtgctggtgaacggtgtgcctgcccggtctccggaggacaaggtggtgccggaggcagtggagattatggtggacgggaccgtgctgcactgccgccgctacacctggatcatgcttcataagcctgcgggggtcctctccgccacggaggacggccggggggccacagtgctggacttgctgccgccggagctccggcggcggggactgtttccggtggggcggctggacaaggatacggagggattgctgctgctgaccaacgaaggaggactggcccacgacatcctctctcccaagcatcatgtggacaaggtctactatgcccgcactgccggctgtctgacggaggaggactgcagggcgtttgcggcaggcatgaccctgggaggcggcctggaatgcctgccggcggggctggagatcctctccgccgggccggagggcagcgaggggctggtcaccctgcgggaggggaagttccatcaggtgaagcggatgctggcggctcggggaaagccggtcctctatctgaagcgggtccgcatgggcaatttgccactagatccggccctggaacccggcacataccgatatttgacggaggatgaggtagagagcctgcgaaatttctaacggccacatcagaaaattcaaatcttgcccaaaaaagaagccgtttttttgttgaaaaaagaaaatatatcttgcattttgacaaattcaacgatataatatatccattgacaatttgcacaacgcccccacgtgtgattttagaggaggaggacgaccatgtctggaagaatttttcaaaatgtggtgctgcagctgaaggaaaatacggaccggacggttggcgtcattgacggtgagggcatcgtcatcgcctgcagcgaactggcgatgatcggccagcggtgggcggagcatgtgcctgccatcaatgctgccggcggcgccatcgtcacgtcggagggaaagacattcaaggccctgaacggctggggaacccagtttgactatgcagccttcgcctttggcgacaacgagatcagcaagaccgtttgcgccatggccacggtggcgctgaatgcagccaaatcctactacgaggagaaacatgaccgggggtccttcatcaaggacatcatctccgataacatcatgctgggggatatctatgtgcgggccaaggagctgcgggtcacagcggacgtgccccggggcgtattcgtggtccgcaccctgaagaaggggagtctgtccccacggacgtgatccagtccctgttcccggaccggcaaaacgatttcgtcctcagcatcggcgagggcgacgtggtcctcatccgccagatgccggagggctccggcatcaaggagctgaacaagatcgcctcctctattgaggaggccctccgcgccggcggggagcccacggtggtggtgggcatcggcaccgtggccacccacctgcgggacttggccaagagctataaggaggcacagatcgccattgaggtgggcaaggtctttgacacggagaagtacgtcatcaactatgagaatttgggcatcggccggttgatctatcagctgcccaccaccctgtgcgagatgttcctccaggaggtgttcaaaaagaaccccatcgacgcactggacaaggagacgctcttcaccatccacaagttctttgagaacaacctgaacgtgtccgagaccgcccggaagctgttcgtccaccggaacactctggtgtaccggctggagaagatcaagaagctgacgggcctggacctgcgggagttcgacgacgccattaccttcaaggtggctctgatggtcaagaaatatctgacctcccggggcatcgactcctgagcctggatggatcacacaagcgccccggccggaattccggccggggtttttcgcgcccggcggagacggaccgccggggaggaaaacggaatcggaagatttgaaaaaggcggttgcattgcggcggaaaaccagatataatgaaaaaagctcttacattatgtcgactggcggggaacctttcggccgcgcccggcgtgtataaaatagggaacacgaggtacagacatgattcgattaaaagacgtggagatggagtacgacaacggcacccgggccatcaagggcattaccctgacgatcgaggacggggaattcgtgtttctggtgggcccttcggggtccggcaagtccaccatcatcaagctgctgaccggcgaggtggaaccctgcgccggacgcattatgatcaacggtttttccgtcagcaacatctcagaaaagcagatccccctgatgcgccgcactctgggagtgatttttcaggatttccggctgatcgagaagaagactgtctatgacaacctggcctttgtcatgcgggcagtgggcgccagccccaaggagatccgcaagcgcatcccctatgtgctggagctggtgggcctggggaaaaaggcggacagctatcccacggagctctccggcggcgagcagcagcgggtagccattgcccgggccctggtgaacaaccccaacaccatcatcgccgacgagcccaccggaaacctggacccggagcggtccctggagctgatgagcctgctggtgaagatcaacgagctgggcaccaccgtggtggtggtgacccacgagaaggacctggtggaccgcttcggcaagcgggtggtcaccatcgattccggccatgtcgtcaacgacagcgtgggcggctatgtggggggcatatccatggctaaacgtcacgatttcagctattttttccacgagggactgagcaatatgttcagccacggcttcatgtcctttgccgccatcggcatcacggtggcctgcctgctgattatgggtacctttaccctggtggcggtaaacgccaatgagctgctgaccaccctggaacaggagaatgagatcctggcctatgtggatgacagctacaccgagacccaggcccgggccctcaagtcccggctggaggccattcccaatgtggcctccgtcaccttcatttccagggatgaggccatggaggacttcaaggcccagtacccggatgaggagctgttccaggacctggacccggagattctggaggaccgctacgccatcaagctggtggatctggaggcgcagagcgagaccgtggaggcggtgcaggccctcaccggcatctccgatgtcagccactacgaggagatcgccggtggttttgtcactgtgcggaacgtagccacggtggtatgcgtggcactgatcgccatcttgttcgtagtgtcggtgttcatcatctccaacaccatcaagctcaccacctttgaccggcgggaggagatcgccatcatgcggatggtgggcgccaccaacggcttcatccgctggccctttgtgtatgagggcttcatgctgggcctgctgggcgcggtgatcgccttcttcctccagtgggcgctgtatgcggcagtggcccggggtgtggatagcaacgacacgctgcagctgatccaggtgatgcccttctcggagctctgggcgccagtggcggcggtgttcgctctagcgggcattgtgatcggcgtgggaggcagcctctccgctatccggaaatttttgcaggtgtgaggtgacgggcatgaagaaagctggcaggcgattccaccgcatcttccgcgccgtgttcgtagcggcgctggccttggctatcaccggcgccaatctggctccggcggcggccgtcacctgggcggacgtgaatgaattgaaggatgaggccaacggcctggacgcggagaaaaaggagctccaggccaagctggatgccctggcggacgacaagagccaggctgtggcccggaaagagctgctggaccagcagatcgccaatacggaggcacagatcgccaatacgcaggcccagatcgaccggtatgccgccctcatcacccagacggaggcggagctggtagaggctgaggaaaaagaggcggcccagtacgagctgttctgcagccgggtccgagagatggagaagcaggacgaggtcagctactgggcggtgctgttccgggccagcagctttaccgacctgttgggccggctggacgccatcaacgagatcatgaagtacgaccagggcgtcatcgacgacctcaaggcccttcaggcggagatcgaggagaagaaggccacgctggagagcagcaaggctgagaccgaggctgccaaggcggagctggtcagcaaggagaatgagctgaacacccagcgcagccaggccaacgccgtcatccagcagctgtccgccaacgagaacgagacggaggccgcactggcagatctggaggcggagcaggacgccctgtgggcggaggcccagcgcctcagcgaccagctggtggcccagcaggccgccaacggccagtccacagagtccaatccaggcggctacatctggccggtgaacagccggtacatcacctccaccatgggcggacggaactctcccggcggtatcggctccaccaaccacaagggtacggacatcggccgggtgggttacaccagctccatctacgcagccaagtccggcacggtcatcgtgtcccagtacagcagctcctacggcaactatgtggtcatctcccacggcagcggcaataccacactgtatgcccacatgtccagccggaaggtgtctgtgggccagtatgtgaaccagggagacgtgatcggcatcaccggctccaccggcaactccaccggaccgcacctgcactttgaggtgacggagaacggcgtccgggtgaatccactgaacgacggcgcagagcccaagatgggatatctcaccggctataccctttcaaaaagtgcataaacaccgctcccgccccgtaggatggggcgggagtgattttatgatcggtatgatgacttggacgccccctgcgggcggcgtccggcaaaagagcgtggttctggagacgcgggccctgctccacctgcgggtggcctgggcgtcggtggccaggggcccccggacaccggaggccctggtgcggcggcgggtgctgacggccgccaagcggctgcggaaggccggtgtcacccgtctggtggtgccggaggcgtttgcctatggggaacagctggagaaggtcggtgtggcgccggtgtccacgctgcctctgcggcgggcgctggcggcggatctggcacgggcggtcatggcagggcggaacctctccggcggcagcgcacggctggcggtggcgggagaccagctctccggcgagctggtgcggaccgtgacggagctggcgctgggaaaccgttacgtgctgctggatgtgccctacggcggcgacaccctggccaatcagctgcggcgggagtacggcgtttccctgctgctgtcccccacccggcagcagatggaagaggcggatgtgctggtgctgttcgcggcccggacggacctgcgacggcgggacccggcagtgctgcggctgtatgatgaggcggcgcctctgccgccgctgctgctgccgccggtgctggagggccagatgcccccgggcctctgccgccctcagctgctggccgtactggtggagagcggcgtcctgcggccggggcagatcaccgtgggcacggcggagagctgacaccgcagagaattttgcaaaaccgcaggcggcatcgcttgacattctcaaatccacacactataatactactctatgataatatagcatcattatgtgcaggggcggccgcatcggccgccctgccaaaggataggagagatacggtccacatggaaagagagtacaagatgagcgcggcccgcgcccaggaactgcaggaagagctgaactatttgaagaccacccggtctgacgaggtggcggagcagatcaaggtggcccggggcttcggcgatttgagcgagaacagcgagtacgacgaggcaaagaacgagcagggcaagctgtattcccgcatcgcagagctggaggagatcctgcagcacgtggtgatcgtggacgagagcaacgcccccaccaacgtggtgaccatcggctgcaaggtgacggtggcggacaagaacggcaacaccatgcccgcctaccgcatcgtgggctctcaggagtccgaccccatgaacggcatcatttccgaggagtctcccttcggcaaggccctggtcggagccaaggagggggacaccgttacggtggaggcccccagcggcgccatcgtctacacggtgcagaagatcgagcggtaaaggagagcggacatgtctgaacagaagacaacccagcagccggagcaggagctgagtgagcagcgccgcgtccggcgggagaagctggcggcccttcaggccgcaggcgaggatcccttccagcagacccggttcgactgggacgccacctctgcacagatcaaggagcactttgaccagatggagggcagggccgtgaaggtggccggccgcctgatgagcaagcggggcatgggcaaggtcagcttctgtgacctgcaggaccgggacggccgcatccagctgtacgcccgccaggacgagatggatgaggcggtctataagaagttcaagaagttcgacatcggtgacatcgtgggcgtcgagggtgaggtgttccgcacccagcggggcgagatgagtgtccgggccaagaacatcacgctgttgagcaaggcgctgctgcccctgccggagaagttccacggcctgacagatctggagctccggtaccgccagcggtatgtggatttgatcgtgaacccggaggtgaagcgaaacttcgtcatccggtccaagttcatcaagcacgtccgggacttcctggatgaacggggctatatggaggtagagacgccggtgctgaacaccatttccggcggcgccactgcccggcccttcatcacccaccacaacactctggacatcgatatgtatatgcgtatcgccacagagctgcccctgaagcggctgattgtgggcggcctggaccgggtgtatgagatcggccgcatcttccgcaacgagggtatggaccccaagcacaacccggagtttaccactgtggagctgtatcaggcctacacggacttcaacggcatgatggatctgtttgaggacctgctgtcctctgccgcccagaagatcctgggcacctatcaggtggagtggcagggcgagcagatcgacctgacccccggctggccccggctgaccatgcatgaggccgtgaaacagtacaccggcatcgacttcatggctatctcatctgatgaggaggcggtggccgctgccaaggccatcggcgtggagctgccggagacggcggaccccacctggggcaatgccctgtatgagaccttcgatcagaaggtggaggagaagctggtacagcccaccttcatcactatgcacccagtggatgtgagccctctggccaagcgttccccgcaggatccccggctgacggagcggttcgagctgttcatctgccgcagcgagatgggcaacgccttctccgagctgaatgaccctatcgaccagaagcagcggttccagaagcaggtggagctgcgggccaagggcgacagcgaggctggcatgatggacgaggactatatcaacgccctggagtacggcctgccccccaccggcggccttggaatcggcatcgaccgctgcgtcatgctgctgaccaactccgacaccattcgggaagtcattctcttccccacgatgaagccgctggaatgagcgcatccggccggagagcctgtgctggcaaacgtccggctaaggccggatttgcggagagctgcaaatggagaagttgacccggcggggcctttgccccggcggaaagagggggagtacgccgctggccggcgtactcctccgtctgctgtcaaggcaaaaaccgccggcagaaaaacggaatcctctccggatatgcgcaccggctctggatttagagcggaatgtgtacggcaccggggcggtcgaacagtggacttgagaagcagaggcacctgcgccgcagggggaggagagagattccggaggcgataaatgggagagcacgaaggcggcacccttccggagaaggccggatccggagctcccacctgggctccgggctgttgaatctgtaacggccgggctgcagcggccggtgtttttttatttataaggtatgaaattccagggtgctgtgaaaaaaatcgttgacttgaatcacagaagagcttatgctatacttgcttttgtataaatccccacagcggtttccatgaaattccatggactgcggcggccaagggctgccgaatgggacctttcgcgctctatgtcccaccgggcatagagcgcatccccgtctccggacagcacctggaacggatggacgcacggggagcagaatgaccggaaaaggaggcgcgccctatggagatcatcaccagccggaccaatccgctgtgcacccatctccgcaagctggcgtcctccgtttcttatcgccgggactgcggggagttcctttgcgacagccccaagttgctggaggaggctttgctgtggagagcgggcctgcggacagtggtctgcacggaccccgccgccctgcctgccctgcccgatactgtccgccgcgtccaggtacccggggatttgatgaaatccatctctcccgcacagacgccccagggcgtcctctccgtgtgcggcctgccgggccggacgcttccggaacagttgaccggccgccggtacgtggtcctggacggggttcaggatccggggaatgtgggaacgatcctccggacggcggacgcctttcacgccgacggattgtttttggtgaacgcctgcgcggacctatacaatcccaagaccgttcgggcctccatgggtgcggtgttccgctgcccggtgtggacctgcgggctggaagagctgcgggcgctgctgacgaagagcggcctgcccttgtatggcgcggcccttcggagcgatacggtggacgtgcggcgggcggacttctctcactgcgccgtggccgttggcagcgaggggaagggcctctcggcggacgcgctggcggcttgtgacctgacggtgaggatcccgatgagcggtcactgcgagtccctgaacgctgctgctgcggcggccgtgctgctgtgggaggcggcgagagacgactgaggagggaagtccatgtccgcgctgaaatactggctgtggctgacggagctgccggggctgacgaaccagacccggctggcgctgctgcagcatttccccacgccggaggacgtgtactacgcggaggcggaggaggtgctgctgaccgagggcatcacccgggagcaggcgatcctgctggagaacaaggactgcgccgctgcggaccggattttggcggactgccagcggctgaatgtgaacatcctcaccctccaggacgcggggtatcccaaccggctgcggaatatttacgacccgccctgtctgctgtatgtccggggccgcctgccggcttttgacgatgaggcggcggtggctgtggtgggcaccagggactgcacgccctacggcgtctcctgtgcggagaagctgggccatggcttggccgccggcggagccgtggtggtcagcggcttggcccgaggcatcgactccgcggcgctgcggggcgccctgcgggccggcggcacggtggcggcggtgctgggcaacggcacggatgtgatttacccaccggaaaatcaatacctatatgaggatgttgcggcggctggcgcgctggtcagcgagtacccgccgggcacgccgccggatggacggcatttcccggtgcgcaaccgcatcctatccggcctctctctggcagccctggtggtggaggcgccggagcgcagcggtgcgctcatcacggcgggcaccgccctggagcaggggcgggacgtgttcgctgtccccggacccattgatgctccggccagcgtgggctgcaaccgcctgatccgcgacggcgccgggctggcgtccgacgcctgggacatcctgcgggaatacgaggcccggttcccggacaagctgcgccgggaggggacgcaggacgcgccccctgtgctgggctatcaggcccgacagaagacggagcccaagccggtggctccgtcggtgagcctgtcccacaataatctgagtctgaccgacgaccagatctgcctgctccggacgctgacggaggagcccatgctggcagacgacctgatcgagctgacgggcatccccactcggcgggtgctgtcggccctgaccgtgctggagatcgagcatctggtgacacagcacagcgggaagcggtacgcccgcgcggtgaatttgacggaataaacacgcgcccgatcctgggcgcttggaggtaactatggcaaaacacagcctggtcatcgtggagtctcccgcgaaggccaaaaccatcggaaaatacctgggcaaggagtttgaggtgaaggcctgcatgggccatctgcgggacctgcccaagagcaccctgggcgtggacctggagcacgactttgagccggtctacaagcccatcaagggcaaggaggacatcatcgccgacctgaagaagtccgccaagagtgcggagatggtctaccttgccaccgacccggaccgggagggagaggccatctcctggcacctgaagcagctgctgaacctgccggacgagaagacccggcgggtcacctttaatgagattaccaagaacgtggtgcaggagagcatccgggagccccgggacatcgaccagaagctggtggacgcccagcaggcccgccgcatcctggaccggatcgtgggctatgagctgagccccctgctgtggaagaagatccgccggggcctctccgccgggcgggtccagtccgtggccacccgcatggtggacgaccgggaccgggagatcgaggagttcaaacctgaggagtactggaccttggatgccaacctgttcggcgacgacgcgaaaaagctccccttcgccgcccgctaccacgggaaggacggcaagaaggcggagctgaagtcggcggaggacgtggatgctgtggtccatgagacggagcacgcccccttcaccgtcaagaccgtgaagcgcacagacaagcagcgcagcccctctccgcccttcaccacctccaccatgcagcaggaggcgtcccgcaagctctccatgacgccccggcggaccatggccatcgcccagcagctgtacgagggcgtggatatcgagggcgagggcaccgtgggcctcatcacctatatgcgtaccgactccctgcggatcagtgaggaggccctggcctccgccaagaccttcattacgggccgctacggcgaacattacgcccagacccaccgctacaaggccaaggcgggcgcccaggacgcccacgaggccatccgccccagcaacgtcaactggacgccggagcagctgaaaaaggacctgaccggcgagcagtaccgcctctaccgcttggtgtggagccggttcgtggccagccagatggccaacgccgtgtacgacagcgtggccgtggaggtcgaggcggcgggacacagcttccgggccagctcctccagcctgaaattctccggctacaccgccgtgtatgaggagggcaaggacgaggagaaagaggagaaggaatcccccttgcccgccctgcgggagggcgaacctctgaccctgaaggactttgaccgggagcagcacttcacccagcccccggcccactatacagacgccacgctgatccgggccatggaggagcagggcatcggccgcccctccacttacgctcccactgtgtccaccatcctggaccgggagtacgtggtgaaggagggcaagtacctccgcatcaccaacctgggccgtgtggtgaccgccctgatgaaagagcggttctccgacatcgcggatctgaaattcaccgccaatatggaacagcggctggactccgtggaggagggaaagaccgcctggaaggacgtgctgcgggagttctacggggactttgagcaggacctggagaacgccgaaaaggctctggacggcgcccgcatcaaggtgcccgacgaggtcagcgaggagatctgcccggagtgcgggcggaatctggtggtaaagtccggccggttcggccgcttcctggcctgtcccggctaccccgagtgcacgttcaccatgccgctggtggtggagatgccgggccgctgccccaagtgcggcgggcggctgatgaagcgcaccggcaacagcaagaagaccggtaagcagtatacctactactgctgtgagcatgtgaacagcaaggacgagacggcgaagtgcgacttcatgacctgggacgtgccggtgaaggacgactgcccggtctgcggccacaccatgttcaagaaggcgggccggggattcaagaagcccttctgcatcaatccggaatgcagcaacttcctgccggaggagaagcggggctatcccaggaagaaggccgcggacagcgccgagggcgcggagtctgccgctgcggcggaggagacagcggagaagaagcccgccaggcggacagccgcagcgaagaaggcggacaccgctaagaccgccgcgaaaaagagcgccgccaagaaaccggcagccgccaagactgccgcaaagaagcctgcggccaagaaggagacggcctccaaagcggcggccaagaccacatccagcagaaagaccgcggccaaaaagacggtcgcgtcaaaggcgaagaagcccgccgggaaggagtgacagctcccgggccaggcggaagccggagcggaagaggaagcgctcctcctgctccgtgcagcgccaggcggcggcctgataggactccagcagttcgatctgctccggggtcagggaggccagcagagcattctccaggcggctctcccgctggtagagcggccagcaggtgccggggaggttttcgtccaggtgctccaggaggttctcgaagagaatgtccagagggtcagtcatgatgaatcatctccaaaatcgtagtttaatttcgtgtttacaatatacacgaaattaaactgcaagtcaaggggtggggcatggaaaattttgcacaacgggtcagacaactgcgcaaggagtctggcaagacacagacacagatggctgctgtttttgaaatcagtgctcgccaataccaaaattatgagggcggcgggcattatccggatgtgccgggattgatgaaaatggcggactacttcggcgttactaccgactatctgctgggacgcagcgaccagaggagctaaggtgatacgggccgccgtccggcggccacggggacttctgctcccgcagggggctggtccagcgggatgcacccccattttcttttccctcttgtggaaaagaaaacgggccgtgcacggtccaaaagaaaagaccgcttagacgcgctccggcgcgttcgcgcctccgcgcgacgggggtcggcggatcggtgcaagcgccgattttggcctgccttcgggcacgcttttcccttctgcaagtttgtaactgccgtcccgtggcggatggtgcggagatcgtcggggtggtcatcgcattgaggtgcttctcttttcgctgccgctggcttggcggttgacgggagctggtgcaagctcccacgaccgccggggcagcgcgtagcgaagcggaacgcgcggaaagagaatctggtcaaatgcgtccttgcaccccgatttttgtcggaaccgcgccgcgggagtcagtgttcaagtctgcaccgtactccgccgcgcccgtcgggaagccctcgcaaccccgcaggcaccatcttacgccgacccccgtacagcaactttgcacgcacgtgcaaagttgcgaccaaaagcgattttttctcttccaccgggcgcggcgcattctctttttgtcaagaacaaaaagagaatggggggcgcatcccccgtggaaacggcccctggcgggagccagattccccgtcccatgggacgcaccatcaaccaacgatagataaaggatccaaactatgaatgtaacagttatcggcgccggcctggccggctcggaggctgcctggcagctggcccagcggggtatcgacgtcaccctccgggagatgaagccggaaaaaaagacccccgcccatgagacggaatacttcgcggagctgtgctgctccaactccctgcggagcgaccagctggaaaacgctgtgggccttttgaaagaggagctgcggcggctgggctccctgatcctccagtgcgccgacgccacccgggtggaggccggcggcgcattggcggtggaccgccacggcttcgcccgcatggtgacggagcagatccgcagccacccccatatcaccgtggtgcccggcgaggtgaccgagatcccggaggggaggtggtcatcgcctccggccccctgacctccgacgccctggcggagcggctccagtccctgttgggggcggacaccgccctccacttctacgacgcggcggcccccctggtcaccgccgagagcgtggacatggacaaggcctggttcggctcccggtatgaccggggaacggcggactatgtcaactgccccatgaccgaggaggagtacgacgccttctggaaggagctgaccacggcccaggaggccccggtccacggctttgaggacaagatggtatttgagggctgtatgcccgtggaggtcatggcccgccggggccacgataccctctgctacggccccctgaagccccggggctgaaggatccccgcacgggaaaggagccctacgccgtggtgcagctgcggcgagacaacgccgacggcacggtgtacaacctggtgggcttccagacccacctgaaattcccggagcagcggcgggtgttctccatgatccccgccctccacgacgcagagtttttgcgctacggcgtcatgcaccggaatacctttttgaactctccccggctgctggaccggtactaccggctgaaagcggagccccggctctcctttgccggccagatgaccggcgtggagggatatgtggagtccgccgcctccggctttctggtgggggtggagaccgctcggcgcctgaccggcaggccgcccgtcgatttcccccgggagaccgccatcggcgctctggggctgtatgtgtccaatccctccgtcacgatgttccagcccatgaatatcaacttcggcatcatgccgcccctggaccatcgggtgaaggggaagcggaataagaacgcggagctgtcggcccgttcactggccatcatcgaccaaatcaagcaggaggtgcgggaagcatgaagatcattgtagacgcaatgggcggagacaacgcgccgctggaaatcgtccggggcgcgctggacgccaaccggaaccatggggtggagatcattctggtgggccggacggcggaggtgctgaaggccgtggaggcctgcggccagaagagcctgcccgcaggggtggagatcaaggacgccaaagaggtggtggagatcgcggatgaccccgccatggccttcaagcagaagccagactcctccctgaccgtgggattgaacctgctgaaggacggcgcgggagacgcctttgtctccgccgggtccaccggggcgctgctctccggggccacgctggtggtcaagcgcattcggggcatccgccgggccgccatggggccccagattcccaccgccgggggacgggcggtcctctgcgactgcggcgccaacgccgagtgcacgccggagtacctgctccagtttgcgtacctgggcagctactacgcccagcgggtcatgggcatcgaaaagccccgggtgggccttctgaacatcggtgcggaggaggagaagggcgacaccctgcgccatgagacctacgccctgctgaaagaggctggggaggccggccgcatccacttcatcggcaatgtggaggccaacgaggccatgatgggcaccgccgatgtgatcgttaccgacggcttcaccggcaatgtgatgctgaaaaccatggagggcgtaggcaagttcctgctcaagtccctgaaggagatgttcctctccagcaccaagaccaagctggccgccggtctggtgaaaggggatctggggcagatgaaaaagctgctggatcccagcgaggtgggcggcacacccttcctggggatccaaaagccggtgatcaaggcccatggcggttccaacgccagggccatcgaaaatgcggtgctgcgggccaaggagtatgcggaaagcggtttcatcgcggacattcaggccaacatcgaacacatgcgggtccagcccggcatggaaaaaaattgatttcctattgacaccgccgtagagattgccgtatgattaccccagcaaggcacagaaccatttttccttgaggggtgaacgacatgtcgaatgaggaaatttttcagaccatgaaggatttggtgtccgagcagtttggtatggagctggacgaggtgacgctggagacctcctttgaagacgacctgggcgccgactctgtggacctggtggagttggtgatggccatggaggaggagttcgagctgggacagacggcggaggacgaggtcaaggccatcaagaccgtgggcgacgcggtgaattacgtggcaggcaagctgaacggataacttgcaggaacgccccgcgcagagcggggcttccttttgggagtggacgatatgcgggatctggagaaaaaactgaattacaccttccgcaaccaggctcttctcgaggaggcgctgaaccacagctcctacgccaacgagcaccgggccggtgggctgcgcagcaatgagcggctggagttcctgggggactccgtgctgggctttgtgacagcggagtttctcttctgccagcacccggaccttccggagggggacctgacccgcatccgggcggccctggtgtgtgagcagagcctgtatgaagtggcgcagaagctgggcctgggccagtatctgaagctgggccggggcgaggaggctggcggcggccgggagcggatctccatcctggcagacgccacggaggcggtgtttgccgctgtgtacctggacggggggatcgaggcggcctccgccctgatccaccgctgcctgctggacgcagagaaggaagaggtagtggaggagcgccgccgggactacaagacggctctgcaggaactggtccagcgccaggcggatcaggtgctcacctaccacatgaccggcgaggcggggccggaccacgacaagaccttccaggcggaggtgcagctcaacggactgcccatcggcgccggttccggccacagcaagaaagaggccgaacaggcggcggccaaggccgcgctggagacgctggaggagacgtgaaccgccttcggccgctgcatacaaatgagcagaccggtcctgaacggccggtctgttttttgcttttctccgggctatgcggaaatatgactggaattttcagcctggccgtgatatactcaagcatgtatgtgcgattttaaatgactgggggattgaatccattgtctttgctgtcatccatcctgctgggcctgatccagggcctggcggagttcctgcccatctccagctccggccatctggccattgcggagcacttcctgggccaggcgggcgttccggcgacgccggacttttttgacgtgctgctgcacctgggaaccctggtggcagtgttcgcggcctactggcaggatatccgggacatgatcgtggagctgatcgacggcgtccgcgatctggttcgcggcaccacacccaaccccatcccgccggcacggcggatgatcctgctgattatcgtgggcacgctgcccctgtttgtggtgctgccggtgaaggatctggtggagggcctgtccggcaatatctatttcgtggcgggggctctgatcgtgacgggctttctgctgttcgccagcgaccgggtaaaaaaaggacgcaagacggagcggagcgccaagctgctggatgtgctgctggtgggcattgcccaggccatcgccacctgccccggcatctcccgctccggcaccactatcaccgccggctgctttgtgggctttgaccggaagtttgcggtgcgcttttccttcctgctgtccatccctgccgtcctgggggccaacatcctgaccttgaaggacgccattcaggagaattccatcatcgtatcggatattcccgtgtatctggtgggagtggcggtggccgccgtggtgggctatatctgtatccgcctgctgaagatgatcgccgataaaggcaagttcggctggttcgcgtattactgctgggcagtgggcctgatcgtgctggcgctgacacttgtgctgaagtaacttgcctttggtgcgcagagcacgtccgcggcggaagcggcatcaggcgtccggcggagccagaccctggaacgggcaggttcggccaggccgctcaggaaagggcctctggaaaaccgaagattttgcggcgcatctccgttgcgctgcattgacggtaaacaaaggagattggaacctcgaaggagagaagcatggcatcctcaacgcagaagaagacgacaacgaaaaagagcggcagccgctccggctcacgcacggccaagggtaagcagcctcagaagcgtcccatccgccgggaggtggggggcgtgatactgctggtgctggcgctgtgtgtgctggtgagctactgcggcgtgcaggcgatcctcatcgacctgctggccaagctcctgaagggactgttcggctacggctactggctggccggccctgccatgctgctggcaggagggatcctgctgctgcaccggggccgcccggtcaccctgcgggccacctgcgccctgctgctgccgctgctggcaggagcgctgttccacaccattttcgcagggggagactatgcgctgaacggctggggcgttttgaagaatctctggacggcgggccttgccctgaaggcgggcggcgccgtttccggcctgctggcggaggcggcggtgctggcggtctccaaggtggtgtctctcttcctcttcggcttgctgctggcggttctgctgctggcggccctgcatgtgacgccttccgccgttctggagatggtacggaaccggccggagtacgaggaggagccggagcctacgcccgccgtccacatcgctcctgcggagccgccccagcggcggggagagcgccagagcaggcccgccatcgacattcccctggacggcgaggagccgtccgcacagccggaggaagagtccggccggtttaccggcttcttccggcataagtccgacaagatgaagacgccggaccaggtgctctccgacaaggaggcggagcaggcggcgctggaacctgcgccgtctccggcccgcgccaaggccgctcccaccccggcgcccgtggcggaagaggtatccgttccggagcccgcccccgcggcgcctgccgccccgcctgccccggcggcggggaagaaggccgtggcccaggaggtagccgctgctacggcagcggtgaccgcggagattgagcagaagctgacggaggatgcggacacctatcagttcccccccattaccctgctgcaggagagccgggaggaaaactatgccgagaccggcgcagagctgcggaacaactcccgccgcctggcggagaccctcaccagcttcggtgtggacgctactgccggagacgtggtccacggcccctccgtcacccggtatgagttcgtgctggaccagggcgtgaagctcagcaagatcaccaacctgtcggatgatatcgccctggccctgggggcctccggcgtgcggatcgcccccattccggacaagatctccgtggtgggcatcgaggtgcccaacaagcaggtgacgccggtgctgatccgggacgtgatcgagtcccgggagttcacagagcacaagtccaaagtggctttcgccctgggaagggatatcggcggccggaacatcgtgggggatatcgagcgtctgccccacgtgctgatcgccggcaccaccggatccggcaagtccgtgtgcaccaactccctgattgtgtcgctgctgtacaagtccaccccggatgaggtccgctttatcatggtggatcccaagatggtggagctggccccctacaacggcattccccacctgctgatcccggtggtgacggatcccaaaaaggccgctggtgccctccaatgggcggtgttcgagatgatgaagcggtacaagaccttctctgagcatggtgtgaagaagctggaggagttcaaccgcctggcccgggccagtgaggacctggagacgctgcccagcgtggtggtggtcattgatgagttggccgacctgatgttggtagctgctaaggaggtggaggagtccatctgccgggtggcccagatgggccgcgccgccggcgtccatctggtgatcgccacccagcggccctccgcagatgtgatcaccggcctcatgaaggccaacattcccagccgcatcgcctttgctgtggcatcctctctggagtccagaatcatcctggacaacaccggcgcggagaagctggtgggcaagggcgatatgctctacgctcccctgggccagggcaagcccacccgcgtccagggctgcttcatctccccggaggagatcgaacgggtggtggagttcgtgaagcagtccggtgaggcgcattactccgatgaggtcatggccaagatcgaggagtccatgcaggagaaggagaaaggcggcaagggcgccgcggccgcggcgccggaggccggagaggacgagggggacgagctgctccccgccgccgtggaggtggtgctggagaccgggcaggcctctgtctccatgctccagcgccggctgaagctgggctactcccgggccgcccgcctggtggaccagatggaggaacggggcatcgtggggcccttcgagggctccaagcccaggcagctgctgatcacccgtgcccagtggcaggagatgcagatgggcggcgcgcccgccccggaggcggacgagcctcccttcccgacggaagaggagacctgacggatgcaggccttcagcggagatttctgaaaacctctgcttgacaaatccccgcaaagacgtataatgggactatcataaacgcgatgacagagccagccctgcgaaaccggcttagaagcgagggggagacggtgcaagcccccagcccacgccgcacggcagccactctggagcagtccgcgaggagcggaacggcccatccccgttaccggatgacatgagatgcctcccattcggaggcagatcagggtggtaccgcggaatggaatgttcgcccctgacagagatgtcaggggcgttttttattgccggccgccgtaaatgagattacaaaatccgaccaaggaggtcttttttatgaaattttccagcaagattcagcggtgtgagctctctcccatgcggaagtttctgccctatgagctggcggcagaggccaagggccgcaagatctatcatctgaatatcggccagccggacattgagacgcccaaggccttctttgacgcggtgaagaatttccaggacccagtgctggcctatgcggcggcccccggcgtgtctgagtttctgacggcggtgcagggctactacgccaacctgggcatccacctggagcaatcggacatctacgccactgccggcggcagcgaggcgctgcagatggccctgacctgcattctggacgagggagacgagatcctgatcccggagcccttctatcccaattacaacacctttgtcagtgtcaccggcggcgtgatccggcctatccccacaactccggaggagggctaccgctacgccgaccgggcgcgaatcgagcccctgatcaacgagcacacacgggccatcctggtgaccaaccccggcaaccccaccggcgtggtcctctccccggaggagatgcgcctgatggcggacatcgccaaagagcacggcctgttccttatcagcgacgaggtgtaccgggagttcgtctacggcggcgagcctctggcctccatggcccagtttgacgatgcggccgagaacgtggtggtggtggactccatctccaagcggttctccgcctgcggcgcccgggtgggcatcctggtgtcccggaaccgggaactgatggcccaggccctgaagatctgccagggacgcctgtgcgcggccacgctggaccagctgggcgctgccgccctgtacggcgtaggctccgactacttctccgccgtgcgggaggagtaccacaggcggcgggatacctgcatggagggcctatctcagatccccggcgtggtgtgcgagtgccccaagggcgctttctacctcatggccaagctgccggtggatgacaccgacaagttccagacctggctgctggaggagttccaggacaacggggagaccgtcatgttcgcacccggcgagggcttctacggcacccccggcaagggccgggacgaggtccggctggcttatatcctgaagcaggcggatctgcggcgggccatggaggtcctggcccacggcattgaggcatacaacagccggaagctgtgagaaacgagcagaggagagcggcaaaagccgctctcctcatgtttttatgattccggtgtccagaggcactgttccagatccaccgtgccgtccaggcgaaaggccacaccctccgcctccagcagggcccgctgggtgccgggggcaaaggtgtcgaaggccgccttggtgccgccgaagcggtccaccacccggtggcagggcacggttgggtcctgacaggacgccatggcatatcccaccagccgggcgctccgtggcatcccggccagccgcgccacctggccgtaggtggacacacttccggcggggatccgccggaccacgtcatagaatgcgccgaagactgtgccgctcacttctcccgcacctcatacagatccgtccgccgggcggagaggatgggcagctgggcccgtaccgcctccagccgttccacgtccaggtccgcgtacagggttgtctcctccgccccggcccggcagagcacggcgccccagggatccacggcgatggagttgccgtaggccacgtaggagccctgttcgtcccgggcgggggagacccccacggtgaagcactggttgtccactgcccgctggcggaagagaagttcccagtgggcggggccggtagtcatgttgaaggccgccggcacgaagatcacctttgccccccgcaggcacatgcaccgggccagctcctcgaaccgcaggtcgaagcagacgcacagccccatggtgccgaaggccgtctcgaaggtggtgatggcatttcccggggagagggtgtccgactcccggaaccgctgtcccccctggacgtcgatatcaaacaggtgggccttccggtgcttggccagctggcggccgtcggggccgtagacgtagctggtgttgtagatccggccctccgacagctccggcacagtcccgcccacgaggtagagccccagctccgctgccaggtgggacagggccgtctgggcctcgccgccctccggttcgccgtaggcgccgaagcagctgttgtcgtaggggcagcagaacatctccggcagcacggcgaagtccgctccattcttggccgcctcccggattttgccgcaggcggtctggatatttttcactttgtctggaagcaccggcatctggatcagcgcaatgcgcataggcgcacctcctcaatcattccgtcatttcccgcagcaccagatctgtggcgcccccgtcgggggagcggagcaggcgcttcacctgcgggtggtgcccgtattccacctggagaaagtcccgcagggccgtgccctgatgacagccatggatcaggcggagccggtacgtcccggccccggcccggcggagcagggcatccaccgtgaccttggcctgataggtgttcctgccgtggaggtccacggtgacgattccgcactccatgggcggctgcctcctctctcccgccggagggcggggaatgctcttctcccattgtaacatgggcggaactgtgttacaatgcaaaaaacagaggaggcatggaagatggcagtttacacggagaaaaagacataccacaccaaggcccacatgggcatgatcgacgtgacggaggactttcagcacgcagtggaggaggcatgccggcagcacggcatctctgccgggacggtcaccggcttcaccaccggcggcgtggcgggcctgacgaccctggagttcgagccgggcattgtgaaccacgacctgaaggcggcgctggatgtgttctccccctatctggatgagaaggggcgggtggtgccttactggcatcatgagacctggcatgacgacaatggatcctcccacatcaaggcggcgctgctgtcccccttcatcacggtgccttttgtgaacggcaaaatcaccgtagggccctggcagaacctgaccctcatcgagtgcgacacccgggaccgggtgcgggacattgtgttccaagtgatgggagagtgagtgcagcgtgggtgccgagcgtccggcattcaagcgttccggcggagcagggaccttggcgcgggcgggctctgcctgcccgcaccagtgagatgcagggcccccggccgcgccaagcggctgggggatgcgacacccgggaccggatgcgggacattgtgttccaagtaatgggagagcaagcagctcggcgcttacaaaaaagatcacagcatgaccaaagaaacacgccccggaatgggggcgttttttttgcatactgctgtcgaaaagcgcagaaaatagattgcaatttgtgcagagttgtggtatccttcttctactgccctttaaagggatgccacaggaaagctttaaatagagaaaggggagagccatggaaaagcggtacggcctgcccacggccatctgcatggtagtgggaatcgtcattggctccggtgtgtttttcaaggcggaaaaggtgctccaggccaccaagggcaacatgcctctggggatcctggcgtggggaatcgtgggcgccatcatgattatttgctcctatgtgttcgccaccatggccacccggtatgaaaaggtcagcggcctggtggactacgccgaggccaccgtggggcggcggtacgcctactacgtgggctggttcatggcagtgctgtacacgccctgcctggtgtccgccctggcctggatctccgcccggtacttctgtgtactgctgggctgggacatcaccggcggcgcctgcatgaccatcgccggggcgatgctgtgcctggaccacgtgctcaacgccctggcacccaggcaggcaggcaggttccaggtgtccaccactgttatcaagatgatccccctggcgctgatggccgcctgcggcgcggcggtgggcatgatgaacggccgcatggcggagaacttcgccaccatgagtaccggcgccatctccaccggcgaggggctgatggcctctaccgtggcggtagctttcgcctatgaggggtggatcttggctacctccatcaacgcggagctgcgggatgccaagcggaccctgccccgagccctggtggtgggctcttttatcgtggtgctcacctatattctctactacatcggtctcaccggcgcagtgacgacggaggagctgatggccagcggcgaggcagcggccaagatggccttccagcgggtgttcggggagacggcgggcacagtggtgttcgtgctgatcgtcatctcctgcctggggaccctgaacggcttaacgctctcctgctgtcgggggatgtacgctctggcggtccggaacgaaggaccgatgccggagctgttccgccaggtggacccggtgaccaatatggcgggcaactccgccctggttagcctgggcctctccgcactgtggttggtgtacttctatggcgccaatgtgggcggaccctggttcggcgccttcagcttcgactcctcggagctgccgatcatcaccctgtacggcatgtatgtgcccatgttcattcaattcatgcggaagagcacggacctgaaccctttccggcggttcgtcatgccggctctggccctgtgcgcctgtgcttttatggtgtatgccgcctttgccgggtatggagtgaccgtgctgtactatctggtggtgtacgccgcggtcatgggcatcggctggctgtttgaccggcggaaaaaatgaaaatagtggaagattagggattgacaatgtggggaaaatggagtatagtgccttcagtaccaaaagggagtagctggcacatttgattgtgtacccaacggcgtcagtacgggcttcggccccgcttcgggttgaaacggcgagacttttgtatcaatgcagaggcattgacgcaaaagtctcgtcttttttgcgtcttgccggaaagaaggagttttatgaaaacggaaaagactatctggcagaagagccgggaagagctgtttcaggagttgagcagcaccccggagggcctgactggcgcggaggccgcccgccgcctggagcattatggccccaatgagctgcaggagggcgggaggaagagcgtcctgcggatttttctggagcagttcgcggactttctggtaatcattctgatcttagccgccgtcgtctccgccatcctgggggatgtggagagcatggcggtcatcctggcggtcatcaccatgaacgccatattgggcacggtgcagacggtgaaggccaccgcgtccctggacagcttgaagcagatgtccgcccccaccgccaaggtggtgcgggacggtcaggtggtccagctccccggccgggaggtcaccgtgggcgacgtggtggtgctggaggccggcgactccatctgcgccgacggccggttgctggagtgcgccagcctgaagtgcgcggagagcgccctcaccggcgaaagcctgccggtagagaaggacttggcggacatcgacggcgacgtgccgctgggagaccgcaagaacatggtgttctccggctgcttcgtcacctacggccgggcccggttcctggtgacatccaccggtatgcacacagagatgggcaggatcgccgccctgctgaagagcacggaggagaaaaagacccctcttcaggtgagcctggaccagttcggccgcaagctctccatcggcattttggtcatctgcgccctcctctttgccgtcagtgtgttcctgcggggcgagaatgtgatgaacgccttcctctttgccgtggccctggcagtggccgccattccggaggccctcagctccatcgtcaccatcgtactgtccttcggcacccagaagatggccagggagcacgccatcatccgcaagctccaggcggtggagggcctgggcagcgtgtccgtcatctgctccgacaagaccggtaccctgactcagaacaagatgactgtgaagaagctctgcaccgggggccagatcatcccggcggacggggcggacttctctcgcccggaacagcgggagctgctgcgtgccgccctgttatgcagcgacgccacggtgaacgaatccggagaggtgggagaccccacagagaccgccctggtgcgcctgggcgagagctacggcttcgacgaggcggaggcgcggggcaagtatccccgtctggcggagctgccctttgactccgaccggaagctgatgagcacagtccaccagttgccggacggcctgaccatgctgaccaagggggccgtggacgtgatgctgggccgcactcgcctctctccggaggagaaggcggagatcgagcggatgaacgaggagctgtcccagcagggcctgcgggtgctggccttcggcaagcggatgctgaccgcccccgccatcggcctggaggatgagaacgacctccagttcctgggcctcatcgccatgatggacccgccccgggaggagtccaaggcggccgtcggtgagtgcatcgccgccggtatccggcccatcatgattaccggcgaccacaaggtcaccgcctccgccatcgccaaggagatcggcatcctcacccccggcaccgaggccgtggagggtgccgttattgagtccatgagcgatgaggaactgcgggagttcgtacccagggtcagcgtgtatgcccgggtgtccccggagcacaagatccgcatcgtccgggcctggcaggagcggggcaatctggtggccatgaccggcgacggcgtcaacgacgccccggccctgaagcaggcggacatcggcgtggccatgggcatcaccggcaccgaggtggccaaggacgctgccggtatggtgctgacggatgacaacttcgccaccatcgtccaggccgtcaagaacggccggaatgtttataccaacatcaagaaggccatccagttcctgctctccggcaacacagcaggcattctgacggtactgtatgcctctctcgcggggctgccggtgccctttgcagcggtacacctgctgttcatcaatctcctgacggactccctgcccgccatcgccctgggcctggagccccacagtgacgcggtgatgcaggaaaagccccgtccccgcagcgagggtatcctgacaaagcccttcctgttgagcgtgggcacggagggcctggtgatcgccctggccaccatcattgccttccacatcggcctggccagcggcggcgctgccgtggccagcaccatggcctttgccaccctatgcctgagccgcctgttccacggcgtcaactgcaagtccggccatccggtgctcttcacccgggccttctggaacaacaagttcctgctgggcgccttcgccgtcggcgcgctgctgctggcggccgtgctgctgatcccaccgctggagcctctgttccaggtggcggagctgtctatcggactggtgggctgcattgtggggctggccttcggctccatggtggtcattcaggtcttaaaagccatccgcagcatgggcaagaagtaaatccactccaaatcaaagcggcagggccgccccttatggggcggccctgtttccttacgcgccggtgtaggtccggacggcatcccgcagaaaggcggcgcagccggggacttcccggtcatagtaggcggtgaaccggggatcggacacatacagctctgcaaggcccacatgggcctggggcgtgtaggactcccaggagtaggacagccaccgccgatggagcgccgcaatccgctggccctccggcccggcggggtccgcccctgctttcacggctgtgacgagagcggtgtggatctcaccccccagggacttccactgggcatactcctcctgggtcagcgccaggacgcaggcgttggcccggtccatctcctcatctccgtatttctcccggatctcctgcccgaaggcggtctcattggcctctaccgtgcggcgcttgaaggcttcaaatttctcctgatcggtcatcttcgttcctcccttgatgtcgttaatcgttcgctggacagtcaggatcagatcgtccagtcgggcccgacgggcctccagctctgccaggtggctctgcagcgccgcctggcggtcaaaggccgggtcgtccagaatggtccggatcgaggccaggtccagtcccagctcccggtagaacaggatgtcctgcaggcgatccagttgcgctgggccgtagaggcggtatccggcctccgtggtccgcagaggtttcagcagtccaatccgatcataccagcgcagagtcctgggcgtgacgccggccagatcggccagcgccttgacggtgtattccatagagatccctcctgtcgattggcagtataacagttgacgctgcggcaaggtcaagggggttcacgaaaaaaaccaggctttctttttccatggcaatgaactataataggataacaccatttcaaggatcacggaaggggggatggcagatgatcaattccaccctctgctatctggagcggggcgacgcttacctgatgctccaccgggtgaaaaagaagggcgatctgaaccatgacaaatggatcggcgtgggcggcaaattcgaagatggggagagccccgaggactgcatcctccgggagacctgggaggagacgggcctgacgctgacggactaccgctaccggggcctggtgacctttgtgtccgatgaggcacccaccgagtatatgcacctcttcaccgccactggctggaccggcacgccccacccctgcgatgagggagagctggcctggattaaaaaagcggagctgcggggccttcccatgtgggagggggacaaaattttcctccgcctgctggaggagaacgtccccttcttctccctgaagctccaataccagggagaccggctggacagggcggtgctgaatgggaggcggattgtatgatacccgctctgacactggagccgctgtcctgggacgatctcccagaggcggcggttctgtgggccgacccggcggtgatccgatggaccaatattgctgccccctgcacggaggcgggggcggcagaccggctggaacacctgctggactgccagcgggggttgccgttctccacggtctttgccctccgggaggggacggcattccggggactggccggctgcccgccggtggatacggccgccgggatctatgggctgttctaccagctgctgcccgcctgctggggccggggcttgggacttgcggctgcggcggaggcactgcggcgcctggaacggctggcaccggccctggtgctggcagacacggtggcagagaataccgccagcgtccgaattctggagcggctgggctttgtccgcaccgccgtccaccacagggctttctgccgggaggggcggatgctggatatctgggactacgcccgccgctgggctggtccggcggagaccgtctgaccgggacggccccgtgcaacatgaagaaatgaggaatgttcatgagcagaaaactgctgctgttcggctttgaggaactgcccaccattctggctgccgcggccgccgccgggcccttcggggcggaggtggtgccggtggcccggcaggactacaacaagcccctggcggtgctggcggggctggatgatgaccccggcacggtactgccgttcaacggcggccctctgggtgggcggatggtggtgctgtgcggcctggaggaccaggtggactgccttctgccggcgctgcgtcaggcggggatcgggcgggactgcctgaaggcggtgctgacgccccacaaccggacctggaccgctgtgaagctctatcaggagctgctgcgggagcaccaggccatgaacgggcggtgagaagatgcggatcctaatctctgcctgtctgctgggggcccgctgtcggtacgacggggtctccaagctccagccctggatctctgatctggcggagcggcacatcctggtccccgtctgtccggagcagctggggggtctgcccacaccccgtccgccggcggagcggcggggagaccgggtgatgacccgggacggtggcgatgtcaccgcccaataccgccggggcgcggaagaggccttgcgtctctgccgcctgctgggatgcgaggcggcgctgctgaaagagcggagtccctcctgcggcagcgggatggtctacgacggcacctttaccggcgtgctgacggcgggagagggtgtcacggcggagctgctgcgcgcccagggcattccggtgtacggagagtcccgggtggcggagttggcggaccccatctgaacaggccagacagccacggacggcgcagcgcccggagaacggggcggcgccgttcttttcctccccggcacggtttacaaccaggggaaaacgtggtagactcgaagccatgaatatgggagaggagagagaaacatgagccgacaggatgtcctggccctgctgcgggaacaggagggggcgttcgtctccggcgaggagatcagccaccggctgggactgagccgcgcggccatctggaaggcggtggatgcgctgcggagggagggctacactgtggaggcccgcaccggccggggctaccgtctgctggatgcgccggacgtgctgacggagccggagatccgccgctttctgggggagacggcccgggtgggccggaccttggtgtgtctggcagaggtggactccaccaatctccgggccagacagctggcagcggagggcgcagcggacggcactgtggtggtggcggaccgccagacggctggccggggccgactgggccggagctttcagtcccccggcggccaggggatctacctgacggccctgctgcggccggatctgccgccggagcggctgtcgccggtgacggccatggctggagtagcggtgtgtcgggccgtagagcggctgtgcggcgtcagccccggcctgaaatggcccaacgatccggtgctggatgggaaaaagctctgcggtattttgaccgagctctccctggagggggagacggcccgcgtgcaggagctggtgctgggcatcggaatcaatgtctcccagcggccggaggatttcacgcccgaggtgcgggagatcgccacctccctggtccaggccctgggccacgctgtgtccaggcccgccctggcggcggagatcatccgggaggtggaccgcctctgcgcagccctggcggcaggagagactggtccttatctggccgagtaccggcggcggtgcgtgaatctgggccggaccgtgcggctgctgcgcccggacggaggcggcgagacggcggaggcattggacatcgatgaggaattcggcctggtggtgcggaggccggacggcgcggtgaagaccgtgcggtccggcgaggtgtccgtccggggcctgtacggatatacagagtgagagacagggggagatagggttgaaagagctttggacattgttttggaccttcgcgaagatgggggtcatgaccttcggcggcggcatggcgatgctgccgattctccagcgggaagtggtggagaacaagcactgggccacagaggaggaactgacggactactatgccatcgggcagtgcacgccggggatcatcgctgtcaacacggccacgttcatcggccagaaatacaagggcatcgccgggggcattgtggccaccctgggggtggtgttcccgtctctggtcattatctccatcctggcggggctcatcaacaacttcgcggacctggcctgggtccagaacgcctttgcgggcattcaggtgtgcgtgtgcgtcctgattttcaacgccacggtgaagctgctgaagaagtccgtggtggataagcccacggcagcgattttcctggcagtgctggtgggcagcgcggtgatggatgtgtccccggtgtggttcatcctcgcggccgcagtgctgggtatcctgctgaagaactgggaggtgaagggggcatgatctatctgcgcctgttctgggagtttttcaagaccggactctttgccatcggcggcggtatggccacgctgcccttcctccacgacatcggggaggccaccggctggttcacccaggcccagctcatgaacatgctggcggtgtccgagtccacccccggccccatcggcatcaacatggccacctatgtgggcttcaccgttgccggtgtccccggcgcggtgatcgccacattgggagaggtgacgccctccatcatcgtgatcctgattattgccgccctgctgcggaacttccgggagaaccgatatgtggaccgggccttctacggactgcggcctgcctctacgggcctgatcggcgcggcctgcgtgtccgtggtacttgaggtgctcaccaacatcgtggtggcgtcgccggagacggggctgttcaaccagttccagctgggggacggcggcctggcgggcctcatcagctggccgggcctgatcctggcggcggtgctgctggcactgaccaattgggtgaaacccacgaagaatctccatcccatcgtgttcatcgccgcctctgccgtggtgggcgtggtgttccgcttcgcgggggtatgaggatagaccgccaggacctgtatgccctgttgcgggcgcggaatatcccctatgaggagacggcgcacccggcggtatggagcatggaggagctccacgcactctgtctgccgggggaggagcggatcttgaaaaacctcttcctgcaggacgacaagaagcggcggtactatctggtggccatagacggcggccggacggcagacctgaaggccctgcgccggacactggacagccgtcctctgagatttgcggacgccgcagacctggagcggcttctgggcctgctgccgggacaggtgacgccgctgggggccctccgggcgcctgccggcacggtcaccgtggtgttggatgcgtctttgcggggccggaccgtgggcgtccatccgctggagaacaccgctaccacgtttttgaatctggacgatctggccgcgctgctggaggaccatggtgtaccggtgatctggtgtccgctgtaatacgcacaagccgcccgccggagaatcccggcgggcggcttgtgcccatctggcagcgggccgtcacttcccatcgatgtggtgctggatccgctgcatgatcatgtccagggccaccaggttgtggccgccctccagcaccacgatgtccgcgtacttccgggagggctccacatactgctcatgcatgggcttcacagtggtgagatactgggagaccacggactggagcgtccggccccgctcctccacatcccgcagggcccggcggaggatccgctcgtccgcgtccgtctccacaaagatcttgatgtcgaacatatcccgcagagtggggttctggaagatcagaatgccctccacaatgatgaccttggcgggctggatctccacggtttggtcggtgcggttgtgctccacaaaggagtagacggggcactggatggagcgtccggccttcagctcctgcaggtggcggatcagcaggtccgtgtcaaaggcgttggggtggtcatagttcaccttggcccgctcctcataggtcctgcccacctggcgcttgtaatagctgtcatggccgatgacggtcacgtctttgccgaagtgttccttcaaatgccgggtcagagtggtctttccggagccggtgcctcccgcaatcccgatcaggatggtgttcatgttcccgattccccctaaaatctcccagttctgtgaaacaaaaccgcgttcttttgcgtccattatagaagaggcgctccccaaaagcaagcggaaccgcggaaaaagcgtaaatttcccagggaatcgacgcttccggtcttgacggcactgggaaaagccgatattatgtaaattatgaaaagctgttacgcgggaggatgacccatggccatgaaacgctgccccatctgcggggaaaagtattccgatacatacaagagctgccccttctgcgaggaggaagaggcgctgcagagcggtgcacagatccgcaggaccgcccccggacggggcggcaaacggacggccgcccgcggccgccagcccaatctgctgagtcccattctgattgtgctgatcgtcattatggcggcgctgctggtctacctgctcttcggcgaccggatcgcccagcgcctctccggcggagaggagacccaggacacttccacagaggatgtgacgccccagccgccggaccctgatacggcggacccggaggggggagacggcgtgaccatgccggagagcggcggcaccggcgagatggaagacccgaatgacggcggcaccaccacacccgcccagacggatccctccaccctgccggagacactgaccatcgcctacctgggttcccccggacggagttcaccatgtccgtgggagatgagcccattcccctgactgtctccggcggcagcggcacttatacctggagcagcagcgatgacggcattgcctccgtggattccaccggccgggtgacggccatctcctccggacaggccaccctgacggtgacggacggctccggcaagggcacctgcctggtgcgggtccggggcggcagcaccggcacatctacgtctgccagcggcggcagcaccgcgtccggcagcacgctgacagcggggaccgcggtggtggtcaacgccgggaacggcgtgcgggtccgcgcgcaggccaacaccagcagtgagattctggcgaccctctccaacggcgactccgtccgggtggtgcagagcgccgggaacggctggtatcagatcagctttgtggcctccggcggcgtaaccaccaccggctatatgatgggcgagtatttgtccaattcctgaaaaaacaacatggcgatatccccggatgttggatgacattcggggatatttcattgcgcgcgggggaaaagtgtgctatcattttttagatatgaattgataaagaaaaaggagagtaccatgacgacccgacagtttcaggagagctccgccctgcggatcttcctgtcctacttcaagccccaccggaagctgtttttcctggatatgtgctgcgccctgatgatcgccgtgatcgatctggcgtttccctacgtctcccggtggtgcatgtaccagctgctgcctgagagcgcctaccggaccttcttcgccgtgatggcggtggtgttctgcgcatacatcctgcggtccgtgttcacctatatcatctgctattacggccacaccttcggcatcctggtggaggcggacatccgccgggacctgttccgccacatgcaggagctgagcttcgactactacgaccgcaaccgcaccggacagctgatgagccgcctgacggcggacctgttcgacatcacggagctggcccaccacggaccggaggacatcttcatctccggcgttaccattgtgggcgcgctggccatcatgttcaccatccagtggcagctggctctggtgatcgcctgcatcatccctgtgttcttcctggtggtgtggaagtgccgcaagtccatgcaggacgcctcgatcaaggtgaagcagcggacggccaccatcaacgccgacatcgagtcgggcctctcgggcatcaagaccgccaaggcctttgccaatgaggaggcggagctggagaagttcgacgtgtccaacgacagcttcaagacctccaagcgggcgttccaccgggccatgggccggttcaacgcggtgatggagttcttcctgtgcatcctctccgtggcggtgatctccgtgggcggcttcctcatcatgcagggccggatggacacggtggacctcatcaccttcagcctgtatatcacgaccttcgtgaacccggtgcgcaagctctccacctttgcggagctgtttgccaacggcaccgccggctttgcccggtttgtggagctgatgcgggaggagcctgccatgcaggatgcccccgatgccaccactctttcccgggtggaggggcgcatcgacgtggaccatgtgtccttcgcctatcaggatgacatggcggtgctccacgacgtggacctccacattcgccccggcgagaccatcgccgtggtggggccctccggcggtggtaaatctactctgtgccagctgatcccccggttctacgatgtgacggacggcgcggtccgcatcgacggccacgacgtccggcaggtgacccaggagtccctgcggcagaatgtgggcgtggtgcagcaggatgtattcctcttcgccgccagcattctggagaacatccgctacggcaagcccggcgcctcggaggaggaggtggcccgggcggcgaagctggcggagatctatgatgacatcgtggccctgccggaggggttcaacacctatgtgggggaacggggcaccctgctctccggcggacagaagcagcgcatctccatcgcccggatcttcctgaaggacccgccggtgctgattctggacgaggccacctccgccctggacagcgtgacggaggccaagctccaggagacctttgagaagctggcccacggccgcaccaccatcatcattgcccaccggctttccaccgtccgcaatgcggaccggatcgccgtcattgaggacggccgcatcacggagctgggcagccacgaccagctgatggcgaaaaatggcgcttatgcggagctggtgcggacgcaggagctgatcggccatggaaaagagtaagttgctggaccgctgcggggccgagggggaggaccggctgctgctggccaaggtcctggaccgggctgcccaggcggaggagcgcaatattcccgcctgtacggactttctctccccacagcagcagatgatggccggggacctgctgcgtcttgcgggcatcccggagaccgcttggctccgtcagggaggctaccagggagcggagcggaacatcctgcttttcctgccggactggatggagccggagacggcggagcccccgctccgatgtctgcggggggccttccggccggacgaccggctgaaccaccgggacatcctgggcagcctcatgggtatgggcatcgtccgggagaaggtaggggacattctggtgtccccggagagtgcggacctgatcgtgctggacacggtggcggatttcctgctctccagctggaacagcgccggccgggcgaagctgacggtgacggagatccccgccgcccacctccacatcccggaggtgcggtgcgaggaggtgcgggacacggtcagttccctgcggctggatgcggtgtgttccaccggttttcggatggcgagagggaaggcggtggatatgatctcttccggccacgtccaggtgaactggcggccctgtacgaaggcggacaagctgcttacagagggggacacggtctccgcccggggatttggaaaatttcagttggcggcggtgggcggcgtcacgaaaaagggccgcaccgccattgtggtgaagcgatatatttgagagaggagggtgcagcgtgctggaatacgagtttgaagaggtatcctgcggcgaggtctacgggttttacttgcgggagaccgctgctcatcgggaggtcatcgtccgccgggcggcggatggctggcgatatgtgggatgcatccccaaaagccagcgccggccttacggctttatcgagagcatcgacctggtattcgagcgccagcggcctgagacctgacaggaggagcgaaacatggagcaaaagcagatcgaccgcatcaacgagctggcccggaaggccaagacaccggagggcctgacggagtgggagcggatggagcaggcggcattgcggcgggagtacatcgactccgtgctggggaacctgaagagccagctggaccacacctatgtggtggatgaccagggcaacaagcggaaactgaagcagaaggaggactgagtgccgtggccggaaagaaacagaagcaggaaggcgttggcgcttggatagccatcgtaatcctcttcgccgtcggcctgtggcccatcgccctggtgatgctgctggtcaaactcttcggaaacgacgggcagaagcggaggcaggccccgcccccgctgcagacggcggcgccggagccggcggccgccgcatccgccgggactgccggcaggaccaaaaaggccgtgcgcagcgccatgaagtccccggcggtgaagaagtctaacgccaagtggctgaagatcattggcgcggtgctggcggtctgcggcctggcggcctgctggtccaccatcgagatgatgatttggctgggcggcgtggagccttggtatatcgaagagctgctgtgggccttagccattgctgctgccggtggggctatgttctgcagcggggtctccatcggccgcagtctgaagcggtacaacaagtatctggccgtggttgggaattacgaggctatggcagtggaacagctgtgccgcaccctgggctattccagggaccgggtggagaaggacctgcagaagatgatcgataaaggctacttcggggatgaggcgtatctgaacatggagctggggtatctcttccgcagcggccaggcggacgcggacctgaaacagaagcgccggcaggaggaggcggccgcggcgccgccccccaaggagacggaggagggctgctccggaatcctgcggaggatccgccgggccaacgacgccatcgcggacccgggactctctgccaagatcgaccggctggagaccatcaccgccaagatcttccgggcggtggaggaggacccgaagaagcgagaccggatcgataccttcctgaactactacctgcctactacccagaagctgttggactcctacgcggagtttgaggctgccggggtggagggggagaacctccgccaggccaaagcccggatcgagtccaccatggacctgattatcaagggctttgagcaccagctggacgagctgtacaaggccgacgccatggatgtggacagcgacatccgggtaatggagaccatgctggagcgggatactgccagtgtggaaaaggactttggcctgggagagttcgcagcggaacagaagccggaagagacggaataaaaagggacccggcgcggaaatccgcgccgggtttctttgcgtcggggacttacttgccccaaacgtccgctaccagatttttgtacatctctacatagaacagggagtccatgcccaaggtaacgctgtcaaagccctcggcaaaccgctggcggctggctgccgcactgccggtaaagatgatggagagcttgccgctgcgcttgcaggccgcctggacccgcaggatggcgtcatggaccaccggtgcgttgaactcgccggggtggcccagggcaatggacaggtcaaagggccccacaaagatgccgtctacaccgtccatagcggtgatctcctcaatgtgctccaggcagcccacagtttcgcactggggcagcagcagcgtctcccggttgctggtctccatatagccggaaatggagaccgcatgggcggcgtggccccagccgccgtcccgggtggggcagaagccccggttccccagaggcgcgaacttggcataccggaccagctcccggacttcctccacggtctccacgcaggggaccaccacaccctgggcacccacgtccagcagccgcagcactgccgtgcgggagatctcattggcccgggccagggccgtcaggcctgcgccctgggcggcggcgatctgggccgcagcggattcgatcccggcgggggagtgctccgtgtccacgatcacatagtccagtccggtataacgcaggctctccaccgccagggggctgccgatggcggagaaggttcccaggctctggcggccctggtgaaatttttctaaaacagtattttccatagcatccgatcctcctgaaaatcattgattctattataccccccggaggatgcctgtcaattccggagtagcgggcaaaaccctccaaaaatcatgccaaaaacagcaaaagggttggcccaaaggccaaccccttcgtactgatatggagagtgcggaaggactgcttacagctcgcagagcttgaggagctcctcccagtttttgtccacttccttctggacctcttcgatcatccactcgttgccgggcttgaacatgtgggcaaagcggccctgcatcttcaggtactcctccaccggcagcttgttcttgggcttgtagctgaggatgtatttgccctcaaccacctcgtacagcggccacacgcaggtctccaccgccatcttggtgacctccatcagcttctcgctgggataccgccagccgcgggggcagggcgccatcacgttcaagaacgccgcgccgggggtgtagatggccttgtgggccttctccgtgatgtccttgaagtttccgatgaacgtggtctgggccacataggggatgccgtgggccaccatgatcttcgtcaggttcttcttctgctgcatcttgccggggatcaccgtgccctgaggcgtggtggtggtgtcggcaaagtggggggtggaggaggaacgctggatgccggtgttcatgtacgcctcgttgtcgtagcagacatacaccatgtcgtggccgcgctccatggcgccggacaggctctggaagccgatgtcgtaggtgccgccgtcgccgccgaaggcgatgaacttgtacgtatcatccagcttgccccgcttcttcatcgcccggtatgccgtctccacgccggagatcgtggccgccgcattttcaaaggcgttgtggatgaagctgtccttccacgccgtgtaggggtacatgaaggtggagacctccaggcagctggtggcggagcacaccaccgccttgtcctccgggttcagggcacgcagcaccgtccgcaccgcgatgggagagccgcagcccgcgcacattctgtggccgccggacaggcggtcctctttcatcaggttttctttcagactatatgccatgactgttttccctccttattcccggacgtccaggtagcgataggtctcgcccacctcgccggtggccgcgatcttctccagctccgcgaacacgtgctgaatgctctccacccgcacgtcgcggccgcccaggccgtagatgtagttgatgcccttggggccgctgatgcccgccgcgtacaggctggccgtgacctccgcgaacatggggccgcagtgggcgttgaagctgtcgtccttgtccatcacggcgaaggccttcacgttcttcagggcttcgcagatatcctcactggggaagggacggaaggagcggaccttgatctggcccaccttcttgccctgggcccgcagctcgttgatggcctccttggcggtgccggcggaggagccgatgatgacgatggcctcctcagcgtcgtccatcatataggtctcgatcaggccgtaggtccggccggtcatctcgccgaattccttgcccaccttgcggatcacgtccttggcgtccatcatggcctgggcctgctgccgcttggcctccatgtagtacacgggcgtggcgtaggcgcccacggccatgggctcgccgggcttcagcagcgcgtgggcgggcttgtactcacccacgaactccttgaccttctctgtctccaccagctcgatgttctcgatggcgtgggaggtgatgaagccgtcctggcacaccatgatgggcaggctcaccgcctccgcgatccgcatggcctgcaggtagttgtcgtaggcctcctggttcgtctccgcaaacagcatcagccagccggcatcccgcacgcccatggcgtcggagtggtcgttgttgatgttgatggggccggacagggcgcggcaggagacggccagcgtgatgggcagccggtcggaggccgccacgtacagcatctccgtcatgtagcacaggccgcaggaggaggtggcggaaatggcacggcagccagcagcctccgcgccgatgcaggtagacatggcgctgtgctcgctctccaccgcgatgaacagcgtgtccacttccccgttgtccacgtatgtagagaagtactgggggatctccgtggacggcgtgatgggatacgcgcccatcacatccgggttgatctgcttcatggcataggcgaccgcctcattgccggaaagtctttctctgattcccattgttccttcccctccttatttctcgtccttgaccatagtgatggcccgaaggggcaggtgttggcgcagatgccgcagcccttgcagaagaagtagtcgaagtcctcccgcttgccctcgccgttcaccgggatggacatatccgggcacaccggcgcgcacagcaggcactgccggcacttgtcccagtcgatcacgggcttcatggtccgccagtcgccggtctccaccacgctggacgtgccgccctcataaatgttgcagcccggggtgatgtccttccaggtcacgtccggggtcatatccttcgccagatggctcatcctacctgcacctcctccagagatctcttcagcgcccgcatattgccctcgatgacctggggcttgctggcgaacttgtgcttgaaggagccctccatatccttgatgaactcctcctccccgatgacgccggacaccctcacgatggcggccagcatgggggtgttggggaagttcttgcccagctcctcctcgctgatcttaccggcgtcgatggtgcagacccggccctcgtagcccttcagcaggggccgcagctccgcgggggacttgctggagttgatgacgatggcgccttccttcttcaatccggcggtcacgtccacggcggacagcagggtctcatccacgaccaccacatagtccgggaagtagatgttggaatggacggtgctccgctcggagctgatccggttgtaggcggtgatgggcgcgcccatgcgctcgggaccgtactccgggaagccctggacatacttgcccgtgttgaacgccgcgtccgccagcagcagcgacgccgttttggcgccctggccgccccggccgtgccatcggatctctacaatgtctttcatgcttgatcctcctcgttcggtttggcccccaagcgggggccgtctcgaaatttgccgttttgagtgcttgtcagcatgtatagtatagtccttttctgcgaggaatgtcaattctataacaaattagacagtatagaaatctgtgaatgccagcggcttctttttgttataagtgcgcaaatagctggggactctgttctgtattcctgcctttttgcacaaaaaagagtcctttttttcggcgctttgctcgctggaagtagcatactccagtatggctgacaggctgggcagccgcagcacaggtgaaaagcggctcccggcaccgtcgtgggcgccgggagccgcgggatgtatttgaaagccgcttaccgggccgcctggagcagcttttctgcaatgacctctacatcttcaccggaggccacaaagtccatgacattgggcagggagagggagcggcgcagcagcgccgtgtagtagcgcatcgcccattcccggccggtgacagagcagtgctggatgatttccacaagctctaccagttcctcccgggacaggtcggggatacagggcggttccggcgtcagtgtgagccgtgccaatgtgtccaggtccgtccagctccagtattccgcaaattccacatcagtgtggactttgcccgtgagagcggccaggtcctccagctccgcgccggcggtaccgggttctttgtctgcaatggctgcaatcagggcctccaccgcgtccagcttgccttcgtcgattcggggaaactccagtgcctttctcatggtgcgcctcctctgaaatcttagcgttttcttaactttaccagagttttgcaagtttgccaagactaatccgctgcatgggactcgcaaaccggaccttgcatttgaggacgaggtgtgctatactgcataatctgaaaacaattctcattttcaaaggagatcagactgtggaaaaacgtattcggttgtgtgccgcgctggcgatggtgcttctgttgaccgcctgcggacaggctccggcggagcatgagagggaagagcggctgacagtggtggctacggtattccccgcctatgatttcgcccgggccgccgggggagagctggcagaggtgcggcttctgctgccgccgggagcagagagccattcctacgagcccaccccggcggacattctggcagtgcaggagtgcgatctgttcctctatctgggcggcgaatccgacgcctgggtggagacgattctggagtccgtggacatgcagggcgaggccctgcggatggtggactgtgtggacctgctggaggaggagacagtggagggcatggaagaccacgagggccatgaccacgaccatgcggaggggcccggcctgggagaagtggtgggctacgatgagcacgtgtggacatccccgaaaaatgccgccgccatcacccgggcggtgggggacaggctggcggagctggacccggccaatgccgggacttacgccgccaacacggagggctacgccacccggatcgaggccctggaccgggaattcgcggacttcttcgccggagtggaggaccggaccatggtgttcggggaccgatttcccctgcggtacttcgcggaggaattcgacatcgactactacgctgccttccccgggtgcagcacccagacagagccctcggcagccaccatcgccttcctgacggacaaggtgcgggaagaggggatccccacggtctggtacattgagttctccaatcatctggtggcggacagcattgcggaggccgcgggcgtcaagacggccctgttccacacctgccacaatgtatccacggacgaactggaggcgggggccacttacgtgtccctgatggagcagaatctggagacgctgcgggagaatctgtgatctgaaaagaagagcgccggggctgcagcggatgtcgcagccccggcttttttatgggaaacggcggagaagcctttgacaggggcgtgcttccgccgtatcataggagtcagagaggagagatggtatgctggcttatacctatttggaaaaaggaaccttccggctgacggacaagccgaagcctgtgctgcgggaacctggagacgcgctggtccgggtgacgctgtccagcatctgcaccagcgacctgcacatcaagcacggctccgtgccccgggcggtgcccggtatcaccgtgggccatgagatggtaggtgtggtggaatcggtgggtcccggcgtccagacggtccgccccggcgaccgggtgagcgtgaatgtggagacgttctgcggcgagtgcttcttctgccgccacgggtatgtcaacaactgtacggatcccagcggcggctgggccctaggctgccggatcgacgggggacaggcggaatacgtccgggtgccctacgcggaccagggtctgacgaaaatcccggagagcgttacggaccggcaggcactgtttgccggcgacatcctggccaccggcttctgggcggcccgcatcacggagatcgggccggaggacacggtgctgatcctaggagcgggccccacaggcatctgcactctgttgtgcgtgctgctgaaagcgcctaagcaggtcatcgtctgcgaaaaggacccggcgcgtctccggtttgtccgggagcactatccccaggtgctgacggtggggccggaggaggtgctggccttcacacaggcccacagcgaccacggcggcgcggaccgggtgctggaggtagccggggcggaggagaccttccgcctggcctggcagtgcgcccgccccaatgcggtggtgacggtggtggcgctttacgataggccccagctcctgcccctgccggagatgtacgggaagaatctcaccttcaaaaccggcggcgtggacggctgtgacagccaggagattctggacctgatcgcggcgggaaagctggacaccacgcccctcatcacccacactgtccctctgcgggatatcgcggcggcctatgacctgttcgagcaccggcgggacggtgtcatcaaggtggcggtggactgcagcatggcgtgaggacagcaggacaacagctccgaagagacagagaggagagaggcagatggatgatgggatgcagtggctggcgggaacgatcctgtcggcggtgatctccagcgtgatcaccgtgggcttcctgtccgcgcttgtgacacggctgcagatccggatcgaccaccggaataacgggatcaagcgggtctatgccccgggagagcacagccgaacactgaaaaagcagctggcagaggcacgggcgatccagcttctggcattgtccggctatgggttcacccatgcatacagacgcatcctgaccgactgcgtggccaggggcgggacagtggaatacctgctggcgcagcccggaaccgcctatatgaaagatgcggctgagatcgagggcagaggggcggactccatctccgaggaggtcggggagaccctgaagctgctggaggccatccggcgggacgccgcggaaaaggcagggaagcagaaagcggagccgggcagagttctcgtcaggtattttcacacggagatgcgcgaacagctgattctctgtacggatcagagcgggcggcgtacggcctggctgtcgctgctgatcccgccgcttccggcgctggagtgcaacatgatcgagtacagggacgcggaggactgtgtggattattatgaggccgtgaagaggcgcagtgagccttgcccagtcgccgtccccggcaggatgcacggaaaggactgagacaccgggcgcgggctggccctcaccaggctatgcggcggtactcgatggccctgcactggcggaccacttgggcacagagagcgttgtaaaattggagatactgtttcttggcctggcgctgggcgcgctgcttctcctgaaacagccgccactgagggcaggtcttgtggcagccctcccggtaggacggacagccggtttggcagggcagcatgggacattcctccgatctcggatattctccgcccggacacggccggggcaggactctgctgtcagtgtagtctttttcccaacggcctgccaccttgaaatggtaaagcgggggtaaaacctctgcgcaggcggaaaaacggggcttgacaacccccgcggtggcatggtaaagtattggctgttcatcggagggcttgtggccgcagtcacaaagccggataagatgctggggggcgcccggtttcttgtccggcttttttttcgcgcctttccggagttgaggagggacatcatggaaacagaacagacctttacacgggggccgatcctgtcgaccctgctgaaattcgccctgccggtgctgctggctttgctgctgcaggccatgtacggcgcagtggacctgcaggtggtgggcaaattcggcactgcggcggacatctcggccgtctccaccggcagccagatcatgcagaccgtgaccatcgtcatcacaggtctggctatgggcatcacggtcctgctgggacagaagatcggtgaggacaggccggaggaggcgggggcggctgtgggcagcggcatctgcctgtttctggtggtggcagtggctgccacagtggcgctggagctggcggcacctcagctggcaatgctcatgcacgccccggcggatgcctttgacggcacggtggaatatgtgcggatctgctccggcggcgcggtgttcattgtggcctacaaccttttgggcagtatcttccgggggatcggagactcccgggtatcgctgatcactgtgctgattgcctgtattctgaatatcggcggcgacctgctgttggtggggggcttcggcctgaatgtggctggcgcagccatcgccacagtctttgcccaggcaatgagcgtggcgctgtccctgctgctgatccgtggaaagcacttggccttcatactccggcggcaggacatccggttcgacggtgccatcattggacggattctgaaattgggcagcccggtggcgcttcaggacctgctggtgaatatcaccttcctggtgatcatcgccatcgccaattctatgggcaccattccctccgccggggtgggcgtggcggagaagctgtgcgccttcgtcatgctggtgccctctgcctatatgcagtccatgtccgccttcgtggcgcagaacatcggcgccgggctggagaccagggcccggcgggcgctgctgtacggcgtgctgtcctccctgatggcgggcctcctcatgggctgggcggcattctttcacggagatgtgctggcgggtattttcgcggatgacccggcggtgatcgccgccgcctgggagtatctcaaggcctacgccattgactgcctgcttaccagcttcctgttctgctttgtgggctttttcaacggctgcgggcagacgctgttcgtcatggcgcaaggaatggtcggggccctgggggtccggctgccggtggcgctgctggtgagccgggcggcggacagctctctgttccatctggggctggccacccctgcctccacggtggtgcagattttcctgtgcggaatctggtacctgcggcgctcccaccggctgaaccggctggggctgatacggaaataaaagatgccccggcaccttcgtgccggggctttccagcgtgcctgtccgcaggcagcgggacggaatcattggagtgcaggacagaagacctgcacttgtccctttgctggacaggctcagtagttccgctccatctcctggatctgctggtacagccagtcgttgacagggacggaaatgccgtgtttggcggccagccggcgaatgatgcctgcaaacagctccacttcgctcttccggtggtttttgccgtcctgccgcatagaggtctcaccgttggagggcaggtggtcaatgatgtccacccatgcggccacgtccttctcagagagcgggacaccctctgcattggccacggcggccacctcccgcatggcgccgatcatggtgtcccggggctttccgggcacctgcagcgggccgtaatcgcactggaacaccagggcggcctggttgcagccggtgttgcacagcagcttgctccacatgtgggtgcggatgtccgccggtacgacataggggaagccgatgctgtcaaaaaacgcggtgagccgctggaggcggctggtgtcctccccggcggggacgcctactgccagttccccaatggggtcgcagacgacgcggttgccctccttcttggcggccatccgctccgccacgcaccagaccacatgctccggaccaaaggcatctcccaggatctcctcgctggagatgccattgaggaccgagatcaggagcgtgtccggtcccaccaggtggcggcaggtctcgatggcgttctgcagaccgccgaacttgacggcgaacagcagtaggtccaccggctctgtgcgagcggcggcatcggtgtaattgaagtcgcagggtgcgtcgttgtaccaaaagccctgcttccggtagcgggcgatccgtgcgccgtctgccagaacggggacctgctccttgccgagcgcccgtgtgaagagcgtggcgtacaggacgccaagggaacccaggccgatgacgccggctgtttgaatgggtttcatcaatcattcctcctgttcatcaaaacagggcggcggaatgctccgccgcccctgttgcttacgcgatccgagccagccaccgcagatcgtagggctcaaacacgaccttttcataggcgtccacatccaggggcgtgccgtcccagtcggagtggatgtcgccgttctgcttgatgaggatgtcgtagaggatgtcgtaggtgacgccgctcaccgggtccgtctccacgatggtggagtaaggcagcgtcttgtggtatgtcagctccattcccttgtagtcgaaatggaagccgcagcgcatccggcagccgtccagtcccgtgtaccgggccaccttcttcagatcctggaggattttgtccccctcctcctcatagaggttctccggtgtggtggcggtgtagtcgaaccggaactgaatggaggcgcccgggagcttgcggaaccgctccatatagggcaccagctgctcggcgggatagttcttgtacagcacgcagttcacccggaagggcaccggcagcttggaaagcaggccgtcgttggattccaccacatagtgctgcatgtggcgggagacgttgatgcaggtgatcttgtgtctgttccgctccgcaaatgccagaatgtccgcctcggactggtgctcggagacgggaagggtggtgttgatatataccttgtgggtagtggggattttgtccagcatcacctggagggactccaggttggcgaagggctcacccccggtgaagacgaagtcgcagtcgggcgtgatggcgtccatccgctcgatgctccggcagatcttctccagggaaaaacctgtcatatccgcatactcgcctttattgatgcagaaggggcagtggttcttgcagtcgtaagggacaaagatcgtcaccgtggcgccgccctcccgcgtcttatagggatgtttcatatcgatcggcctttcagagtaaaatggaaaatccgtgaaaaaatggtctccaaaaaccgcgttgaaggtcttgcagacaatgttatattttaaaggatttttcaacagaggtcaagagtaaaagggaaattccccgtgagaaactccgaaaaaacgctgacacttctggaaaacctgcacaaatcccgcctgcagcgccgccccagtggaaagatgccggtgaaggcagggctgtacatttcccggagaaaatgctataataacaaactatgcaattgtgtttcaagagaggaggcggacccatggagattctgcaggggctgctggacaacctgacggccctgctggcggcacatccgctggcgggggagtggtatatggcctttgtgcgctttctgtttccggctctggccgtgctgatcctgtaccgggcggtccgctctctgctgcggattccccacacgccggagaactggggccagctgagcctgccaaacggcacgtccctgcccctgacccactgggagaacatcctgggccggagcaagacggcggacatctatctgaactatcccagcatctcccggcagcatgccgccctctgccggggcgaagatgagaactggacgctgtacgacctggggtccaagggcggcacggcggtgaatggggagaaggtggcgtcctccgttcccgtgaagctgggggataccatcactttagggggcgtgccgttgatcttcctgcctcagaccgtggcggagcgggaggagcaggaggcgaagcgccgggcggagcgccccgccgccatctggccgtctttcctgtggctgacggtgtttcaggtgctggcctgtctgcagctgctcgtggccgccgggactgaggccaccatcgccatccccctggccttcctggggctgacggtgctgatgtggctctattacgcggccctgcgggccactcgctgcgtgggctttgagatggagaccatcgccttcttcctctccacgctgtcactgtccatcactgcctccagtgcccagagcagtctgttcaagcagttcctggctattttgctggggctggcgctgtttttggtgctgggactgttcctgcgggacctcagccgggtgcagaagaaccgctggctcatggcggccgccgccatcggcctgctgggcatcaccctggtgatcggcaactccaaatacggcgccgtcaactggatctccattggcggcatgtccttccagccgtcggagatcgccaagatctgctatatcttcgccggcgccgccacactggagcggctgttccacaagcggaacctgaccctcttcatcgtgttgacaggcgtgtgtatcggcctgctgggcctgatgagcgacttcggcaccgcggccattttcttcgtcaccttcctggtgatcgcctatatgcggtccggggatttcgccacactgtctttgatctgcggcggcgctgtgtttggagcgggcatcattttgaagttcaagccctatatcctcagccgcttcgcctcctggggccacgcttgggaggccgcctccaccaccggctaccagcagacccgcaccatgtccgccgccgcctccgggggccttttgggtatgggggccggcaacggctggctccataacgtggcggcggcggacacagacctggtgttcggtatgctgtgcgaggagtgggggctgctgatcgccgtgctggcagtgggcgccatcatcacgttggcgtttttcgccgcacgggcctgccgggtggggaggtccagcttttacaccatcgcagcctgcgcggcatcgtccctgctggtgtttcagacctgcctgaacgtgttcggttccgtggacctgctgcccctcaccggcgtcacgttcccctttgtctccaacggcggctccgctatgatgtccgcgtgggggctcctagcctatctgaaggccacagatacccgggagaacgccagctttgccatcgcccgcaagcaccagcggcgcctgacccaggcggcccgccggcgggtggagccgataggggaccccttcggcacggaaaaggaggaacgccatgaagaaaattgagcggcgggcctttgtctgtctggcgctggcgctgctgctggcggcgggcctgggattcttcctggtgaaatacttcctggacggcggcagctgggcgtcctccgccttcaaccgccacctgtacaatagcagcggccagcttgccagcggcacggtgctggaccgggacggggacgtgctctccgaggtggtggacggacagcgcacctattacgacaatgccaccgtccgcaaggccactctccatgcggtgggggacctacagggtaatatcggcaccggggccctgaatgcctttgccgacaagctgaccgggtacagcctgctgaacggcgccttcggcgcccagcgggggaacgacctgtatctgaccattgacgcccggtataactataccgcctatgaggcgcttggcggcaagtccggcaccgtggcggtctacaactacgaaaccggagagattctgtgtatggtctcagcccccagctacgaccccctgaacgtgccggaggacatcaccaccaacgaccggtacaagggcgcctatctgaaccgtttcctatcctctactttcacgccgggatccgtgtacaagaccgtgaccctggcggcggctctggaggatatcccagacctggcggatcggacctggacctgctccggcagcgtccagatgggggacgagaccatcatctgctccggcacccacggggagcaggacatcgcctccgccttcgccaacagctgcaacgtggccttcgcccagatcgcccaggagctggggccgggcactctggagaagtacacggagcaggcgggcctgaccggcagctattccatcagcggcctgcctacggcaaagggctcctttgactttgacaacatcaccgacggtcagctgggctgggccggcgtgggacagtaccacgaccaggtgaacccggcggcgctgatgatctacatgggcgccatcgcaaacggcggcaaggcggcggagccgtatctgatcctccggaccgagagcgccctgggtctgccgtccctgccccacttcaccaccaggaccggcacgctgatttctgccgatacggcggctgcgctggcggacctgatggccaacaacgtgacccagacttacggcgccagccgctttcccaatatggacatctgcgccaagtccggcaccgctgaggtgggggagggccagacgccccacgcctggttcgccggcttcctccgggggaggagacgccttacgcctttgtggtgctggtggagaacggcggcggcgggtcctctgtggcgggcggcgtggccgccaaggttctggatgtcatcgtcaacggatattgatacgaaagcgggagcaagatgaacgacaagagaaagggtctgctgtttcagaccaagaaacagatgaacaacggagctatcgccacggggttgggattcgtgctgtacctggccctgctggcgatggggctggagctgccggcggacttggtggccgttgccttcggcgtggtgggaattttcaactccttctccgtgctggaggggcggcgcaaggacaaggagaatatctcctacaatctgctgtggggacagctggcgctgaccatcttcctggtggcctgcgcggtgctggccgtcaagcagcggctagggctgtaaaaggaaaagcggcgggaatccatcggattcccgccgcttttttcttattcggaaacggtctcctcttccaaagtggggggacttccaccggcgcgggcgcgccctccggcagcagctggcgcttgacctttttcatggcccacaggaaacagatcacgtggacgccgaaggtaatagcccagctgatgggataggaccagtagatcgtctggatggtgtggaactggggcagctgaaaaatggtggcgatccacagcagccgcaggccgcaggcgcccaccagggacaccagcatgggcatgatggagtagccgatgccgcgcaggccgcccaccatcacgtccatcatgccgcagagggcataggtggtgcagacgatgcccatccgcaccaatccggcctcaatgaccgggggactggtggtgtagatggacagcagtacccgacctgccagcgtggcggcgttgcccagcaccagccccaccaccagcacgcagccctgggcgcggatcatgatcttgcggatgcggtggtagttaccggcgccgtagttctggctggtgaaggaaatggtggcctgatacatggcgttcatagacacgtatacgaactgctcaatgttggccgcagcggagttgccagccatgatgacctcaccgaaggtattgacggaggactggatcaccacgttggacagggagaagagaatcccctggaatccggcgggcaggccgatgcggaggatctgccgcatggcctgggggtggagccgcatcttcttgagatccaggtgcagcgggccggtatccttcaccatgcagcggagcaccagggaggcggagatgcactgggagatcacggtggcgatggccacacctgccacgtccagcttgcagacgatgacgaagaagagattcagcacgatgttgacgactcccgccagggagaggaagtacagcggccgctgggtatcgccctccgcccgcagcagggcggcgccgaagttgtagaccatggtggccgtcatgcccaggaagtagatccgcagatacagcgtggccagatccaacacgttctccggggtctgcatccagatcagaatggtccgggcaccgaagacgcccaccactgtcaacaccaggccgctgatgatgctcagtaggatggaggtgtggactacccggtggagcgcgtctctgtctcgggcgccgtagtatttggccgccagggtattggcacccacggccagacctacaaacaggttggtcagcaggccgatcagcgcggtgttggaccccactgccgccagggagttgtccccggcccagcggcccaccaccacgatatccgccgcgttgaacagtagctgcagtacgctggagcacattagcgggatggagaaccgcagcatcttggagagaatagggccgttgcacatatcgatctcataatgagtctgctgcttgcctgccatgtcagaaaacctcgtatatgtcccagaatttgcgctgtatgacgcaagccatattctagcacggagcgtctggaaatgctactggtttccacgaaaaattttacacgattttaacattggaaattctcaaaaagctgtgccggagagacaaagcctctccggcacagctgaattgaaaggaaatgatcttagaaggcaggtactacggcgccgtcgaaggtctcggtgatgtagtcccggatggtgtcggagtggagagcatccaccagggcctgaatagcctcgttgttctcattgccctccttcaccaccagtacgttgacatagggggagtcgctggactcgatggccagagcgtctgtggtggggttcaggccggcgcccagggcgtagttggagttgatgacggccagatccacgtccgcaagcacgctggggatggtggcggcctccagctcctggaactccagattcttgggattgtccacaatgttgttgggagtggcggtcaggttggagctgtcgtccagggtaatcaggccctgggcctccagcagcaggagggcgcggccctcattggtggcatcgttgggaacggcaatgacggcgccgtcgggcagatcctccagggaggagacccggcccgcatagatgcccatgggctcgatgtggacgccggccacgctcaccagatgggtgccgcgggtctcgttgaactcctccagatagggcaggtgctggaagtagttggcgtcctcgtcgccgtcctccacggcggtgttgggcaccacgtagtcgctgtactcgttgaccaccagctcgatgccctgctccgccaggatgggcacgcactggttcagaatctcggcgtgggggtgggagaggcggccaccgtcagggtgacggtctcagcggcatcgctgccgcaggcggccagggacaggcacagggtcaggcccagcagcagggccagcagcttctttttcatgtttcgttcctccaataaaatatcgtttatgatgtatttcaaacgcttgccggattttcaagagacaaacgatgaaaacgccgggggtcacttggtatgggcaaagcggggcaggagatcgagggggccggattttttggcgccggacggctggtccagccgcttatcgatgcgccgggacagccagttgaaaatcagctggaccacctgcaccaggataatcaggaacaccaccgtcacccacataacggaggtgatgccccgctgatggccgtaccggacggcgatgtcgcccaggccgccggcgcccacggtgccagcgatggcggtataggccagaatcgtcaccagggagatggcgccccccaggatcaaagagggcttcgcctccggcaggtacaccttccagacgatctggagggtggaggcgcccatggactgggcggcctcgaccacaccggcgtctacctcgttcagggaggtctccaccatccgggcgatgaagggggcggcggacaccaccagaggtacgatggcgcctttgacgccgatggtggtgcccaccaccatccgggtgaagggcataatggccaccatcagaatgatgaaggggacggaccggccgatgttgacgatccagtccagcacccggtagacgccccggtggggccggatgccgtggggctgggtcaggatcagggccacccccagagggaggccgatcagataggcgaatgcggtggagatcaccaccattaccagggtatcccagacaccatctgtcaacacattaccgtattcggcccagaaggctgcaatagactcaaacatggtattccacctcctccgcagagacattgggctgcgcccggatatagctgagggctttggcggcctcattggggttgtccggcagcccaagcagcatggtgccgaaggccctgccctcgatgttgcgggtgtcggcacccagaatattgaccttcacccccaggtcgatggcgagagacgcgatcaggggctgatacgccgtaccgccgttgaaggccacgcggacggcgtgagtacctgccggatactgttccaggctgacgccaccggggtacaccagccgccgggccgcatccgtatggggattggagaagatgtcctccaccttgccctgttcagccaccacaccgccgtccaggatcgccacccgggagcagatctcttcgatgacgctcatctggtgggtgatgaccaccacggtgaccccaagcttctcgttcaggtccttcagcaaggccaggatggaggcggtggtggtgggatccaaggcggaggtggcttcgtcacacagcaggaccttggggtccgtggccagggccctggcgatggccacccgctgcttctgtccgccggagagctgggagggataggcatccgctttctcccgcaggcccaccaggtccagcagctccagggcccgctttctggcctgggcagcgggggtaccgctgagctccatggggaagcagacgtttttcagcaccgtccgctgcattagcaggttgaagctttggaagatcatagtgacgttccgacgggccagccgcagctctttttcgctaagggccgtcatatccttcccgtccacgatcacggtgccggaggtgggacgctccagcaggttcatgcaccgcaccagggtgctcttgccggcgccggagagaccgataattccgaagatctcccccttctggatgtccaggctgatgtcctccagggcatggacggcgttttcacccgttccaaaggtcttgtacaggtgctgaatttgaatgatagacacgggataacgctcctttccggtgaattctggcaataaaaaagtccttgagacaaaagtctcaaggacgacggaattcgccgtggtaccaccttgattcgcacgcttcctcacgaaagcggccttggggagtgcaaacacactcctgcgctgtgacgtgcgcccacgtcgtgacctatgccgggacggcggtcggccacgcaactccgagaccatgttctccaagcccttccagacctcttctcaccacacgaggctctctgcgctgtatctgcctgggtactcttctcttcatcgtcttttgctatcaggttattcaataactgtctcatagtttatctgataacaccggaaaagtcaacagggcaacctgcatagaaatccaggcaaaagacatgtggttctgtgagtttccacaaagcggcgtcgggcgctgtcgaaaccgggaattttttcaagagaagaggcagtatcggattgcaactgctgggcaaaactgctatcataaaatccacaagacccaggaggatggaggaacggcgttgaggcggaagcgggatcggaattttggcatacgctggctgcgggacctgctgtgcggcgtcctgatcggggccggcgccatcctgccgggggtttccggcggggtgctggcggtggtgttcgacatctaccgtccctttatggaggtgctgacccatccccgggaggccatccccaaatactggcggtggtttctgcccatcgggctggggtgcgccatcggctttctgggctttgccaagggcatcgccgcggccatcgacgtgtccagcaccgtcactacctggctgttcatcggcctgatcgtgggcacggtcccatctctcttccgggaggcggggaaggagggacgcagcatcggctcttgggtcagcatggcggtgtgcgccggcgccatcttcttcagtctgttttacgtaggaaaagtgatttgcgtcaccgtggaacccaatttctggtggtataacttctgcggcgccctttggggcatgagtctggtgattccagggctgacctcctcctcggtaatgatggccctggggctgtaccagcccatgctggaagggctggcccggctggacttcctggtgctctccgcctgcctgccggggatggtgctgacaatcctgctgctggcaaggctggtgagctggttcttccggaagcactactccatcgctttccacgggatcttcggcatcgtgctggcctccacattggttatcatccccaccagttatgtgggcgcgtgggagattgtgctgtcggcggtctgctgcatcggcggctttttgctggcctacttcatggcccggctggaccggcggatccaggagaacggcagggcctgaaacatgaaaaaagtcccctctgtgttccggcacagggggactttttcattacagatcgaacacgcccatgatggcaatgcccgccacgatcagcgcgatcatggcgtagtgcttccaggagagcttctccttcaggaagatccggctccacagcacggaggccgcgcagtaggaggcgatgatgggcgcggacatggccagatgctccgtgtccgcgatggcgtagatgtaggcgaactgtccagcggtctcgcagacggcgcccagatacttgggggcctccatcttcggcaccagccggtcccgcttgatgagcaccacatagacgaagcacaccacggcggccagcaggaacgtcagctcataggccacgttggcgctggcctcgtagtcctccacggtgcggctgatgatctccagcacccggctgtcggcaaaggtgccggcagcgtccagcacgcagtaagccgcaggcatggccagggccatgaagctcttggtgtacttgtagttgcttgccttctgccgctcgatgcgcagttcgtcatcctcccgggcctccaccacacccaggcccacggcgcccacacacaccagcgccacggcgaacagggccaggggggagtatccggcgatgccgtcaaagaggatagccagcacagctaccagggcgccggaggagttgcagataggggaggagatggacagctcaatgtaccgcaggcccacatagcccatggccatagagagaatgtacaggatcgagacgggcaggtatgtcaggatgatgtccagattgatgaccgtaccgcccacaaagacctcgtaggccgcgtgaaggcccatgacaacgcccacggccatcaccattttcaggtggctgtacttgtcccgggcatcgcggcagccgattttggaaaagaggtcggagccgctccagcagagcagcgcgatcagagagagccaaaaccacatattacgtttttctcctaaatcactgtattcaaagcgttatttactttccggcagagttaccagacccgcctccaccagcttctggagggacatgaggattcccaacttggcgtggtaccaagtgaggccgccctggaagtagacggcgtaagggggcggatgggcccgtcggcggagagctcgatggaactgccctggacaaaagcgccggcggccatgatgacgtcggagtcatagcccggcatggcccagggctccggggtcacgtagctgtctaccggggcggcggcctggatccccttgcagaaggccaccatggcctcggcactgcccagggtcaccgcctggatgatgtcatggcggctctccgtggcgttggggacgcaggcgaagcccagcttctcatagatgttggcggcaaagacagcgcccttcaaagcgccggacaccaccgtgggggacaggaacagcccctggtagagggcgggcatcagacccaggttggcacccacctcttgacccagtcccggggcggagagccggtaggcacaccggtccacgcactccttggtgccgcagatgtagccgccgatgggggcaagtcctccgccggggttcttgatgaggctgcctaccaccatgtcggcccccaggtccgagggctcgatggtctccacgaactcgccgtagcagttgtccaccatgattttcacgtccggcttgatccccttgcagaaggcgatcagttccccgatctgccggaccgagaaggaggggcgggtggcgtaccccttagaccgctggatggtgatgagcttggtgcggccgttgatcttctcccggatggcgtcgtagtcgaaggttccgtcgggcttcaggtccgcctgggcataggtgacgccatactccttcagggagcatttgctctcccggatgccgatgacctcctccagggtgtcatagggggctcccaccggggacagcaactcgtcccccggcagcaggttggcggagagggccactgccagggcatgggtgccgcaggtgatctggggacggaccagagccgcctccgtgtggaacacatcggcgtacactcgctccaggttgtcccggccgtcatcgttgtagccgtagccggtggtggcggcaaagtgggtggcgtttacccggtttttctgcatggcggccaggaccttgccttggttgtactctgccgtctgatcaatgacgtcgaaccggggccgcaagtcccggagcaccgcctcgccgtattcatagaccgcccggctgacgccgagctgttcatacatggtcacaatttccatggtcttcctccgttgttcccaaaatttcatctgccaggtcgctgaggacctggggctttgtcaccaccaggccgctgacctcattgcccaaaatcagcagggtgtctccgggagagatgccaaagaaccggcgggcctcctgcgggatgacgatctgtccccggtcgcccactttggcagtgccaaagacccggtttttggacatgcccagcatgtgtttgcctccaggcatggagctacctccttgaaatcatacttttcacacaagtgtgaatcatagcacaaccggaagaacttggcaagaggaaatttttcaaaacggaaaatggtgcaaaatgctttggagtgtgttatcatacctccaaagatcaaaatgaggaggagcacctatgaattggcggacggtggacatgtcccgggagtcccggcgggaccaatttgcgtattttcagaccctgtccaacccctatgtgggggtgacggtgcaggtggatgtgacggagctggcagtctggtgccgggagagaggaacgagcttctttctggcggtgctgtacgctgcggtccgagcggccaacggcgtgccggagctgcggcggcgcatccggggcgatcaggtggtggagtacgaccgctgcccctcctcccatacggtggctctgccggacgggacctactgctactgcagcctggaggtggaccggcccttccgggagttcctgccctacgcggcggcggagcaggagcgggtgaaggcggcgcccaccctggaggacggagaggacggggagagcctgttctttgtctcctgtgtcccgtggctgtcctacacggccctgacccagccaaccccaacgccggcggacagcaatccccgcatcacctggggccgctggcaccgacaggagggccggactctgctgcctatgacgctgctggccaaccatgctttggtggacggcatccacatcgcccggttctatgagaatctggaccgggagctggccgccctctgcggcggggagaaaacagagtactgaatcaggaaaggagagagcggcaggtgaggcgctgcattgtggtggccgggatcgcatgaatcaaatttgaaaggagaatttcctcatgcagattccggcgaataccatctatccccgcacaggcgaccgggagaccgtctatctgaatgcagtggtgtcagaccccaatatttctgtggggattacacgatctacaacgatttcctccgggaccccacggaattcgtgcgcaacaatgtgctctatcactaccccatcaacggcgaccggctggtgatcggaaaattctgctccatcgcctgcggcgcgaaattcctgttcaccagcgccaaccacacgctgaagtccctgtccacctatccctttcccatcttctacgaggcgtgggacacgtctgtctcggagatcacggagacctgggacaaccggggggacattgtcatcggcagcgatgtctggatcggctatgaggccgtcatcctctccggcgtgcggatcggtgacggcgccatcgtggccgcccgggcggtggtggctggggacgtggagccctacaccatcgtaggcggcgtaccggcgaagcccatccggaagcggttcacaccggagaccatccaccgtctggagcggctccggtggtgggactggccacgggagaagctccagctgctgctgcccctgctccgccggggtgacctcacggcactggagcgggccgcggagaaattctaatccacacaaaaaccgggcggcacacaactgtgccgcccggttggatatttactcttaaaacttacacctggataccgcccacaaaataggtattgtagtacccgctggtcaggctgctgacgatgacaccgccgctgcgggaagaggaggagtggatgaactgcccatctcccgtgtagataccggcatgggaacatgccttgccggcgttgcggctgggatcgttgaagaacaccagatcgccgggctgcagctcggagatagagtatacccgggtgcccaggccactctgccactggctggtggcggagtggggcagggagtagccgtgctggctgtacacgtacatggtgaagccggagcagtcaaagccgcggggagaggcgccgccgtacacataacccgtgcccaggtactgcttggcggtggccgcgatgtcgctgttggaggaggaagactccgtcaggtccaggaagtcgctgcggatgtaaccctcggtgccgtactcacaggtgacgtcgtaccagccgtccaccaagccgttgaccgtgacgatggcgtcctcctcaatggtggccagcacagagctgtcggtagaggcgtcggagcggacgttcacgccgtcggaattgacgcggccgtatgtagtgaagacattgtcctgatctacgttcaggtagtcagcagacacatagccggtgctgccgttgtaggcgatcttgtaccagccgtccacggagtcatccaagatcgccaccgccacactcttgtccagcgtggtgaccacggaggcggaggtagagggctcggcccgcagccgcagggaagaacctgtggtgcagccggcgccggtggcgatgtccgctgccagggcggtggccgccagcagcattgcggtgagaacggagaggaacaggaccttgcctgctctgcctgcgaagtgcgtcataggtgtacgttcctttcgtcagtcttttgtagcgcggggaaaaggtcctgtttcttacagcttgccagcaagagcacgatccagccagacggtggcgatgtccatcgccgcgtagaggctgtccttctcgctcttcttgaccacacggtcccgggacttcagctccgggtccgtcagctgcagctggatggagaccttggtggccacctccatgtcctgctccttcttggtgttgaggatctgcatcatgatgatatatttctcagccatcgtgccgtagtagatcagattgtccacccggcgaaggggatggcccttgtatgtcaaaccttctgccttcttggacttgctctctgccatggaaacactccttcaaaagttgtaaccgaattgtaacagattttatccgctttgtcaacgtttggtcacaagaaattacagccaattcctgggaagagacctgccttcggccctggacgcaaaaaatcccgcagggaaggtcgccgcgccattcgcacggatgccctctctgcgggggaatgcagaaggaaaacggttactgccccaaatatctgcggaccagcacctgcagcagctcgtcccggtcgatcttgcggatcagggtccgggcattgttgtgattggtgatgtaggtggggtcctcggagagaatataacccacgatctggttgatggggttatagcccttttcctccaatgcccgatagacggtcgagagaatctgatggatctctgcgtccttctccgtggcaatattgaatttcctggtaaaatcgtccatacagacaccacctttcccgaagggagcaccacttcataatacaaaactagtatactcgttttttgaaaaactgtaaagcgttttccgcatgaaatttgaaaaatacgccccgtaatcgctgggagggcgctggaccgaaagaacagggggtccagtgcagcagaacggccttcggcccgcctcacagcgcctccgggagcggcgtctgcatcggcgctgctgggggattggatttgagccgggcggaacgcatccgcccggctcaaggtttctgtctgcgcaatagcacctggacgcgacggcacacaagcccgctgtgcagtccgcaggcggccgcatattaccgcaggacggcgttcagctctgccttcagcgtctccaggatgctcttcacatcctcatcggcctcctgagcggtgaggctgcggtcgtcggagcggagcgtcaggttgaaggccacgctcttcttgccctccgggatgccggagccggtgtagatgtcgaacagggacacatccttcagcagccccttggcgccccggcggatgcagtcctccagcgctcccacggtgacggccctgtcgcacaccacggcgatgtcccgggtgacggcggggaacttgggcagggggacatattccgggtcggcccccttggcattctccagctcgtccatggccagctctgcgcagtagaattccgcgtctacgccatagttcttggccaccagggatggatctggccgaaccagcccaggcagtcgctgccgctccacacctcggcaaagcggccggggtggtaggagagctcctccggcaggccgctgccgatgcggaaggtcacatccttcacccgcagttcctggaggatcgcctcaatggcgcccttcatagcgtagaagtccatgtcgccgccgtaggcgcccagggtcagtgtcttggactcgatggccaagccgtcctcgccgccgggcaggtacgtccggcccacctcatagagcttcacgtcctgattgcggtagttgtagttccgggtcaggatctccagcatggagggcagggtggtggtccgcatgatggaggtatcctccccagggggttcaggatcttgaaggagttccgccgctggtaatcttccggccagcggatcttgtcgtactgggtcggggagatgaaggagtatgtgatgatctcatcgtacccgaaggcccggcacacgctggacacccggcgctccaggatctcggcggcgccatagccgcccagggtggtctggccccgcatcagggtggtggggatgttgttgtagccgtagaaccgggccacttcctccgccagatcggcgatgccctccacgtcgccccgccaggaggggatggtcacgtcggcagggccgccggggcagctgtcgtccgctgtgcggatgtccacccgggccagataccggtactgctccgctgcggggatgtcggtgcccagcagcgcgttcacccgctccgggtccatgcggatggtgtggggctggggcacgtagttgaggatgtcgatgacgccgtccactacctctccggcgcccagcagctccaccagctcgcaggcccgctggacggcgggcagggtattcaggggatccagacccttctcgaacttggcggaggcctcggtccgcatccccagggacagagcgcccttgcggatgcaggtgccgtcgaagcaggcggactcgaacaccacgtcggtggtgtccgccacgatctcggagttcaatccgcccatgatgcccgccaggcccacggcccggtgctcgtcggcgatgaccaggtggttggcggtgagcttgcgcacgttgccgtccagggtggtcagttcctcgccctcctcggcccggcggacgatgatgtggccgcccttcacatagcggtagtcaaaggcgtgcatgggctggccgtactccagcatcacatagttggtgatgtccacgatgttgttgatgggacggacgcccatgctccgcagccgctcccgcatccacttgggggagggggcgatcttcacgttccgcaccatccgggcggtgtaccggggcaccagatccgcggcaggggtctcgatgtccagcaggtccgtcagcacgccgtcggcgccgccctgtacctccggttcgtggagagtcaggggctgctggtaggtggcggccacctcccgggccagaccgatgacgctgaggcagtcggggcggttgggggtgatctcgaactccaccacatggtcatccgcgccgataatgggcttgatgtcatcgccgttctggatcccttcctcgtggaggacgaagatgccgtcggggatgcagtgggggaactccttctggtcggcgtggagatcctccagggtgcagatggcgcctgtcttggtgttgtaggccaccaggtccccctcgtggaggttggggcagatggtgtccggcacagcggtggagccgcccaggtccagacaggtgtggaaggtgtagtccggctggctggcgcactccaggatcttggcgcacaccaccggcccgaacaccttgtcaccgggctggatgtcggcggggatggagggcttgtccttgtccagggggtggtagtcgttcaggatggcggcggggacgatagcggcgtaggggaagtcccgctcatccagacccagctcatagaggccgcacatcatgccgttggactccacgccccgcagcttgcccttctcgatcttcttgccgccggggagggtggagtggtccagggccacgggtaccatatcgccggggtggatgttccaggcgccggtgacaatctggatgggcgcgctctggcccacatccagctggcagatccacatgtggtcggaatccgggtggcgctccatggtgaggatggtgcccaccacgatattggagatctcggctccccggtcctcggtggtctccaccttggagccggagagggtcatggcctcggcaaagtctttatcgttggcgtcgacgtgcacaaactcgtccagccactttctgctcagtaacatatcttctataactcctttatatcggaatgcgggagtgccccgcaaaagcctcgcagagtttcacgccgccggcgtgaaaaaatatccagtcattttcggaaggacacgtgcctgccgaaaattccctgactcagccgccttgggcggcgttcaccagtgaccgatgtcactggtgagggggaatctaaagggggacgggatcccctctttaagaactagaactgttccaggaatcgcacgtcgttctcaaagatcagccgcaggtcggcgatcttgaaccgccgcatggcggtgcgctccaggccgatgccgaaggcccagccggagtatacctccgggtcgatgccggacatcttcagcaccttggggtggatcatgccggcgcccagcagctcgatccagccctcgcccttacaggtggggcagcccacgccgccgcacttgtggcactggacatccatctcgcaggagggttccgtgaaggggaagtgatgggggcggaaccgggttttggtgcccttgccgtacagcatctccaccaccgtgttcagggtgcccttcagatccgccatggtgacgcccttgtcgatgaccatgccctccacctgatggaacatgggggagtgggtggcgtccacctcatctttccggtacacccggccgggggcgatgatgcggatgggcagctccatggtctccatggcccggacctgcatggggctggtctgggagcggagcatcacccggctgtcctcgtcaaagtagaaggtgtcgctccagtcccgggaggggtggccctcgccggcgttcagcttgtcgaagttataggtggccagctccacctccgggccgtccaggaccgtgaagcccatggagatgaagatctccttgatctcatccagcgcggtgtacatggggtgcttgtggcccagcttgtgggccttgccggggacggtgatgtccagcgcctcggcctccagccgctcctccagggccttttccgccaggacggcggactgctgctcgatggcggactccacatctgcccggacggcgttggccagctggcccatgacgggccgctcctcggcggagagcttgcccatctgcttcagaacggcggtcagttctccctttttgcccaggtactggacccggagggcctccagctctccggtgttcccggcggcgccgatggctgccagcgcgccggcgcgaatggcttccagttgttccttcatacgtcagactccttttttgagttaggagcgtggagatcggagataggaactggggcggccgctgtgcggctctattgggatcatccggctttgccggataccaaaactcctatcttctatctcatatctcctatctttgtgataacaaaaaacgcctctcgtcccatccctgggacgaaaggcgaatccttccgcggtaccacccggattcgcgccaaaagcggcgcgcactcgtggccccggtaacggagggcggaccggccgtgtctccacggcggctcccgggcgaaccaaaccgggcgtccgcagtctggcttgcagccggtggccagacctctctcggcggcgtatcacggttattttcccgttcatcgctgataacaattaacacttatagcacagaaacgggacaaatgcaagccccgattcgccgaaattcagcggatcggggcggaaattttcagctcaagagccggccgtccaccaggtcctccacctggatggcggacacctcgccgtccgtgatgaaaaaggagatgtgcttgcagtaggacaggccgccgggctcgtggatcagggcgtagtcggcgccgaactggtcctcgcccaccgcctccatctgcaccgcaccggtgtagacggcttttacatcgtcctccgagtcccccacctggatgcctcccagggtccgcggccccggcaccgtggtggtcatgcggtagatattgtcggttccatccgcatccagatacgccacatccacgcctccaaaggaaaacgtgaagagcgattccccgttgtcccccgtcccggcggactggggcgtctccgggagaccctcatagtcccaggggtatccgccctctttgcgccccagggagaggaactgcccctccgtcaccagacagaaggaggcggtggcgttttccgttgcccgctcgatggcctggggccgggcctccttcagggcgtccagcagggcctgctgggcgtcgttttccggctggtaggtgtccaggatctctgtcagccggtcctgctcctcctgaccataccaggcgtaggtgtcgttcaccggggcggccaccacaatgtcggcgtgctcccaggggctgtccgggaagacggacaacgcatcgaaccaggtgtccgggtcctccaggaaccgcctggttaaatagtcggtggcaccttcggaataagctccgtccgcgtggagcagccagcaggccagcttcaggtcggaccaggtgtcgaggttaccggcgtcatcacgcatgaaggtatcaatatcataggtgaactggaacaccgtctccgcctccaggtccagcccgtcggagggaacaaaggaagtgaatttccagccgtccgccgtgtgttccagatccagcaccgcctgggagtagccgacggtggtactgggtttctcaaaggcccagctgtcggcgtagaaggtgaccgtcaccgtccagtggtccgcatccacctgctccgccgccacggtcttgtccagcaggtacaggttgctccctcggcccccgtcggtggcgtagagaacgccgtcgaagtccttgtagtgatccggggacagggcgaagaggttgtccacaatctccggggagaagtaggactccgccgtctcccgcaggtctgccagggacgtgatcgtgaccggctgcggctgccagggaagcgcactgtccgtgagctctgccacggtagaaacgggcagggagagattctccgcatccacccggtagtaggtcaggtctccctctgtgcgggcgtcctccatgtccaggggcagggtggtcagatcaaaccagtcgtataccgccgacgcggcggtatacatattgataacgtcctgttccgtcagagcggtctccgggcctcatcgggcgaaaccggagattcccgcccgccgcagccggcgagcagcgtgatggtcaggagaagaagcgccccaaaacgcctcatgggcagcgcctcctttcgttcctttttgaagcatcatatcacattccaccggaaaattcatgacgatctggttacaaatgattgcaatccggagcgggaattcctataataggcaccagaaaaccatgaggaacacaggaggttacggccatgaagctgacgacggcggagcagatgaaggagctggaccggcaggccattgaagagcggggcattccctccatcgacctgatggagcgggcggcggcaggcgtggcagaggcggcgctggcgctgctgcccaagcggccggggaaatgtcgggggcggccttgtgcggcgcgggcaacaactgcggcgatggaatcgccgcagcccggctgctgtttttgaaggggctgaaggtccgggcgttcctggtaggggactatgagaagctgacgccggacgccctggaggagacccgccgtctcagcgagtgcggtgtggagctggagcggttcgacccggcggacgaaagccagcgggcctgggtgttggggtgcgacgtggtgatcgacgccctcttcggcgtgggcctctcccggcccatcggggcaggcacgccctttgccgcggcggtggactggatgaatgagagcagggccgccgtggtggcggcggacattgccagcggcgtgtcggcggacaccggcgccgtgctgggccgtgcggttcgggcggatcgcactgtcaccttcacactgcccaagatcggtcaggcagtgggggagggggccgccctctccgggaacgtggaggtccgggacatcggcatcccggcggatctggtccggggccttgtctgccgggcccagacggtggagcgggactttgcccgtgcggccctgccgccccggagggcggacggccacaagggaaccttcggcaaggtgctgatcgtcggcggcgcagtgggctataccggtgcgccttatctcactgccgcggcggcggtgcggaccgggtgcgggctggtgtccctgggggtgccggagaccatctggccggtggaggcggccaagtgcgtctctgccatgccattccctctgccggacaaacatgggaggctctctcccaaggcgaaagaggaaatcctggagcgggctgccggctgtgacgcagtggctctgggccctggactgggccggggagatggcgtcacggagctggtgctggatctgctgcagaagatccagcagccgatggtgctggacgccgacggcataaacgccctgggggacatatagatgtactggacgcccggcgagaccggatcacggtgctgacgccccacgacggggagttcacccgcatcggcggcgacctcaccggcagcaaccggctgggggccgcccgggcctttggagcggcccatggctgtgtcctggtgctgaagggccaccggaccctcaccgccgccccggcggggaacgtgctggtgaacaccaccggaaattccggcctggccaagggcggcagcggcgacgtgctgacggggattgtcgccgccctgctggcccagggggcgactgccgttcgggcggcggcggtcggcgtgtggctccacggccgggccggggacttggcggcggagcgcctgacgccctatggtatgacgccggaggacgtggtgtcgtcactgccggcggccatcggggagatcctataaaagacggaggtttttgcggtgcgcagatgggcttgcataccaatgatgaccctgtgcctgctgctgacggcctgcggcggcacaggcggagaggcgggggatgcggcggatgcccggatgccctatcggaacatggcgggctgcgtcatggaggcggaggtctcctgcacgcaggacggcgcggcctgggaggccacgctccagtgcgactacgtgccggagggggagaccactgtggaggtcctggcaccggagaccatcgcgggcgtgaaggcagtgctctccgacggggaagtggaactggtgtacgaggaccagtgcctgaacgccgggaacctcagcagccaggaggtgagccccatggcctgcctgccccagctgatgagcgccctgcgggacgggtggctgctggaggagagcgaggaggactggcaggagacgtcctgcttccgtctgacggtggaccagaccggagagcagaatgggaagatcctctccaccctctggctgcggcaggaggacggtacgcccctccgaggggagatcgccgtggatggggaaatcattttgacggcagactttacgagcttttccttttatgatacaatagaaaaccaggaatgacttcggcgggagggttcctcccgccgcttccatagactgacggagaaggtgaccgacacatggaggaaccgattctgagacggacctgggcggagatcgacctggacgccctggcccacaactatcagcaggcccgcagaaagatcgggcccaacgtgaagtatttgggtgtggtgaaggcggacgcctacggccacggggccattcaggtgtcccgcaagctggagcagctgggggcggactatctggcggtgtccagcttggacgaggcgaaagaactccgccgggccggcattcaggcgcccattctgatcctgggccacacgcccccggccatggtgccccagctgatcgagtacggcatcacccaggcggtgtccgccctggccaaggcggaggcgtacagcgccgcagccgtggagagcggcggcacactgaaggtccacatcaaggtggacaccggcatgtcccggctgggtttcctggtgcgggaggggcactttgacacaggcgtggaatccatcgccgccgcctgcgccctgccgggactggaggcggaaggcatcttcacccacttcgccgtctccgacgaggacgacagagacagtgaggcctatacgagagcgcagttcgacgtgttcacccgtgtgctggatgcattggctgcagggggcagaacctttgccatccgccactgcgccaacagcggcgctctggcccgctatccggagatgtatctcgacatggtgcggccgggcatcgccctgtacggcgtgggcgccgatgcgcagcggctggacctgcggccggtgatgagcctgaagtccagcgtctccaccatcaagacctttgacccgggcacggacgtcagctacggtcggacgttccgcacccagggaaggacccggatcggggtgttgcccatcggctatgcggacggtttcttccggggcctctccaaccggatgtcggtggtgacagcccagggcccagcccctcagcggggccggatctgtatggacatgtccatgatcgatctgacagacctgcccgacgtcaaggtcggggacgaggtggagatcttcggccgccgccagcgggtggatgacctggcggccattctgaacaccatcccctatgagctgacctgcgcggtgagcaagcgggtgccgcgggtgtatatcgaaggcggtaaaatcgtggagcggagcctgcggctgctgtgagcgcagggaagcgagccgccgcagcgcggcgtccaagcgttttgccgcgtgcggcaaaaccttggggagagcgggctttgcctggccgaccaaaatgagatcggggtccccgccgcgcaacgcgcggtggggcctgacctgtgcggtgagcaagcgggtgccgcgggtatatatcgaaggcggtaaaatcgtggagcggagcctgcggctgctgtgagcgcagggaagcgcggacacaaatccatacacacacgccttgttccgggcataggatagtgcggggcgaggacgccggaattttgcggcattggcaaagtataaattccgtacctgcgtgggagaatgaaagtggcctcaccgaagggccttcggtgatgggtacttctttcggcggagtgtgaactttgtggatacgagtgtcaagcgcggcgatatttactatgccgatctctccccggtggtgggcagtgagcagggtggtgtccggccggttctgatcattcagaacgacaccggcaaccggtacagtcccactgtgatcgcggcggccatcacttcccagaccgggaaggccaagctgccgacacatatcgaccttcccgtggaccacagctgcggcctgagccgggattcggtggtcctgctggagcaggtgcgcaccctggacaaaaagcgcctgcgggaaaagatgggccatgtggaggagaatgtgatggagaaggtcgatctggccatcgcggtcagcttcggactgccccacgaccagatggtttgagagatccgtttcttcggcaatacacaggccgggcgctgcggcggaagccgtctcctggccgcccggaaatgcgtggtttgatcgaagggtcctcctgaaaagggcgttccgcccttttcaggggtaccgatttttcagatccgacaatcaatacggaggtacataagcgcatgaaaaagaacagatggtatctgcggctgctggcattgctggtgctctgcggcgccttgaacgtgacgattaccgcggcggcggaggccggatcctccgacgacccgctggtgaccctgagctacctgaacgagacgttcatggactccatcatggagcgggtggaccagaagatcgccgcccggaatgcccagttgggcatttcggcaggcagcggagccggtgccgcgtccaacttcactgtggtgaccctcaccagcggacaagtcctcactggggacatcggctgtgaggtaatgctgcgagtgggaacggctgtgtgcgtttctccctccagccccggtctcattgacgagaccgcagccacagcgctgaacaacggcagtgcgctggtccagaaccacctgtacatgatgaccattgagggccggggcgtccgcgccacggccggcaccaccaagctgctggtccggggcagctacaccgtcgcctgatctccgcataaacggccccgcctgggcataggttgtgccaggcggggccgtttggagagggggcagagcgatggacaagtttccactgatgcagggctgtttctctgtgggggagctcatcacggagcaggaggcgctgtacacctggtttgaggcccggtgccgcctgccgggagagggcctctggtgcgcctgggcggtgggcgaccggggagagctgcggctgggcgttctggagccctgtggggaccgggccacaatccggcggcggttttccgcccggctgacagcccctctaggaaagctgcggcagggggagatccgccctgcccatccgccggagccggaggattggacgccgctggagcgctcggcagtgcgtctccgttccccatggcttcgggagcagctgcaccttgtgccgggcgtccttgtccgggaggagcaggggcggcgagagctggcggtgccctatgacgtgggccgcccctttccgctgaccgccttgttctgctttgcccatatccgccgtatccatggccggagctacgccatctttgccttcaacggggaggagcgaccggtgttctgagccgtccggcggacagagacattttcagaaaattccaaatgatgtgttccacatttcccgggggtatgatataataaccccaagacggccgtggcggaggggctctccgcccggcctcagacacgggaagacctgccggccgggcgccggcggagcgtttggaggtccagtatgaagtgtccctattgcggttacagtgagagcaaggtcattgattcccggcccgcggacgaaaacagcagcatccgccgccggcgggagtgcctttcctgcggcaagcgatttaccacctatgagacggtggagagcctgcctatggtggtggtgaagaaggacggcagccgccagagttttgaccggcggaaggtgctgggcggcatgatccgcgcctgcgaaaagcggccggtgcccttggcggagctggaaaagatcgccgaggagatcgagcaggatctgcagaactccatggagcgggagatcagcacagaggccatcggcgaaaaagtgatggaacggctgcgaaacgtggaccaggtggcctatgtccggtttgcctccgtctaccgccaattcaaggatatcgacacctttatgacagagctgaacaagctcctggccgacaaccggtgaaggccgtcagaggacgttcttgatatccagccgctccgtctccgccaggagccggagctgatcccgcaggtccgagatctccgcccggaactccgtcagctcccgggtggcggcgaaggccagggcccggcggtacatggcctccgcgtcgtccaccgtatcatgccgcgccacgatgtggaggtaggtctggctttccgaccagtcgtcatagctgcctgccagcgtatccacggcctcggtccaggcctctgactgggcttgggcgtccgcctgctgcagctgctcccgccagcggacggtgctggcggtcatgtaggagctgttccacagggaaaagaccaggatggctgccaggatgccgacggatattccatacgccctcatgactctcgctcctttcggacgcagaatacctgcccctgttcgtccagggtcaggaggaagatctcgcggggagaggaggctttttcccgggacagctgcttgcgcagccagttctcgtcccggccgcaggcggtcagattgcggtggatgacccgcccgtcgttgatgatgaccatgggcagtgtcacatcatcctccagccccagtcccagttgttccgccgtgggcggctgctgggctgtccagggaaagacggtcagctggccggagttttccagcacggcgtacttcacgtcctcgatgcgggtgacgccctgctcccgcagttcctccatcagctcatcgatggtaaagcggttcttccgcatggcgtcctgctgcagcttgccgccccggatcaggaccgtgggcgtcccgcagatcagcgcccgcagccgcaggctgcggagagacagctgactcagcagcagtgacagggccagcagcgtcaggatcggcagcaggccagagagcagcggaatgccgaagtcctgcatgggcacggcggccaggtcggagatcatcatggtcagcaccagctcgctgggctccaactcgccgatctggcgcttgcccatcaggcgcatcccgaccacaataaggaaatagagaatgatcgttcggacaaaggcggttatcatggcgaaaatccctccgttccgctagtatctgccggaacgggatttttatccgggataaggctcccccaggagggggagattcttgtaaagcatggaaagaaaatatagagttatacagcaacagttttgagaattaataagaaaaaataatgatggattcaagtgttcacaaacaattacatttcaaatcggtaaacgccgaaaaccgcagggaagttgagggcttgactgtcttttctgagcaggctggttttattgagagtgtaagcgagtgcttgcgggaggcagatgaattggagctgtggcggcctgttggtatttatgacagcgacacgctgattggttttgctatgtacggctattttccagagccggctccgggacagctatggctggatcggctgctcattgataaaagatatcagggaaaaggatatggaaaacaggcggtgctttcgcttcttgacagattgcatacagagtatcagagcggcacggtatatcttagcgtgtatgagaataatccccatgcaatcaagctttatcaacagattggtttccggtttaacgggaaatacgatagcaagggggaacatatcatggagtatcatttttgagagatgtagagccagtcaacggtcaatatgtgctgaatcgtcttaacagacctatttaagatgggcttatcaggcgcatattatagtgaccgcatcaaaatcaaaaaaagaaaaatcgcagatgtgaaaggagtttatgggccgcggcccatcacagcgccagcgcccgccgccagcggcgggacgacgaggggaagggagtatcgaaggattcggcggatgcccttccgtgcccacgggcgcgtacacagccggcaaatatgcgggcaaccgcaaaacaagggggctgtgaccgtgaagaaagtgacaaatgactgcgtgtttgtccttttgaccattcattacagaatcttcaggaggattatcgaatatgtgcggaatcatcggatttgtaggaaacgagcccgcggcccccattctgctggacggcctggagcggatggagtaccgggggtatgactccgccggcgtggcggtgcggtccgagacggcgggactccaggtgcgcaagaccaaggggcggcttcaggtcttatccgacctgatccacggcggcgcggacctggaggggaacctgggcatcgggcatacccgctgggccacccacggggagcccaatgacatcaacgcccatccccacgtcagcgagaacgggcggatcgccctcgtccacaacggcatcatcgaaaactatctggaaatcaaggagcacctcatgcgccagggcgtccacttcacctccgacacggacacggaggtggtggcacagctgctggagttccactacaacgaatgccacaacatgctggaggctgtgggccgctgcctgcggcggatcgaggggtcctacgccttcggcatcatctgtgcggattaccccaacgccctcattgccgcccggaaggacagccccctcatcatcggctacggtcagaacggcaacttcatcgcctccgacgtgacggctgtcatcaagtacacccgggacgtggtgtacatggacgatggggagatcgctgtcctcaccgccgacagcgtggacgtgtttgacgacgagctgctgccggtggagaagacccacagtctggtggactgggatgtgtccgcagcggagaagggcggctacgcccacttcatggccaaggagatcatggagcagccggaggcggtccgcaagaccatctccccccgcatccgggacggccgtgtggtgctggacaatctgcatctgacggcggagtacgtccgcgacctctcccggatttacgtcatcgcctgcggctccagctaccatgtgggcgtggtgagcaagtacagctgggaaaagctgctgcgccgcccggtggaggtggtgctggcctccgagttccggtactgtgatcctctggtggacgaaaagactctggtcatcgtcatcagccagtctggagaaaccctggacactatggccgccatgcgggaggccaagcgccggggcggccggaccctggccatcgtcaatgtggtgggcagctccatcgcccgggaggcggatgacgtgctgtacacttgggccgggccggagatcgccgtggccaccaccaaggcatacaccacccagctggtgctgatggatctggtgggcctctatctggcggacctgctgggtatggtggaacagagcgagtatgacaccattctctccgagatgcagctgctgccggagaagatgcgccagttcctctcccacacggaggacatccagtattacgcctcccggtacttcaaccacgactccatcttcttcatcggccggaacctggactacgccatgggcctggagggttccctgaagctgaaagagatcagctatatccactcggaggcctacgcctccggcgagctgaaacacggcaccatctccctgatcgagccggggaccctggtggtggccctgggaacctacgcgcctctctttgacaaagccatgagcaacgtggtggaggtgaaggcccgggggccgaggtgctggccctgaccaccgaggacttccgggaaaagatggagaagactgccgacgccactgtctctgtgccggtgacccatcccatgctccagccctctctgggcgtggtgcccctgcagctgttcgcctactatgtggcgctccagcggggctgtgacatcgacaagccccggaacctcgccaagagcgtgactgtggaataacgaattgccgcccggaccatctggtccgggcggtttttttacttgacttatatagggaatcgatatataatggcgctgtcaaaatatatagaatatctatataaggaggaagtctatggaggccgataagagtctggtcagcggcagcatggccctgttggtcctgaagctgctggaggacggggacaagtacggctaccagatgaccagcgagctgcggcagcggtcggaggacgtgttccacctgaaagcggggaccctgtaccccctcctccacagcctggaggaaaaggggctggtcaccgcctacgagcgggaggccgctgccggtaagccccggcggtactaccatctgacaaaggcgggggaggccgccctgcgggagaaggagacggcgtggcacacctatgccgatgccgtgggccgtgtgctggggggaggtgcctgctgtgccgggacctgagagcgtccggggctatctggacgcggtggaggcacaaatccgctggaagcgggcccggactgtggcggcccgggagctggaaactcatctggaggaccagcaggaggaatttctggccgaaggccatccgccggaagaggcggagcgcttggcagtggaggatatgggggacccggtggccgtgggcgcggacctggaccgcctccaccggcccaggccccagtgggggatgctgggcctgaccctggcgctgctgctggtgggcggctggttgcggtacgccctcacccgagcgggagcaccctgggatgaggatctggatccgctgcgctgtgctctgtcagtggtgaccggggctgctgtgctggtcggagcctacttcctggacgtctcccggctgctgcgctgggccaagtgggtgtacatcggtgcggtgatggcgggggtattgtccctacatctctcacccaatgtcaacaacgcctcttatttcacccggtatgtggtgctgttctatccggcagtctacgcactgtggctgtatgcctgccggggaaagggctggcggggcctgctggctgccgtggcgggcggcatccctttgacggtggtctgtatgtgtgcgccctttattcaggggatgattcagctgatggttattggctgctttctgctgttgctcgctatccagatggactggttcaccgtgccccggcggcagggactggcggcggtgggcggactggctgctgtgatggctggagcggtgctgtggatgctgttggtggcgggctataatgcagcgcggattcagattctcctgcacccggagatagacccacagggggcggggtatcaggctgtaatggctcgccggatacttggggcatcccgcctgatggggaagggaggagacctctcaatccagccgcaaacggtctggggcagggaactgctcccggagatgatgctgccggagtggaaccacgattttctgcccaccaccatggtctacaaactggggtggttgccctatctgctcctgctggcagttttggctgtcctgctgctgtggatgctgcggcgatgtgcctgccagcaaagccagagcggaaagctgctggcactggccgttgtcctgacgctggcggtgcagtcggcctttgcggcggcgctgaatctgggctttgtgctgttcagcgcccagctccctctggtgacgggaaatctccacagcatggtggactgcgccctgatcgggttggcgctgtcggccttccgctcagagtccattttgcgggacgcggtggttccggtcccgcggcccccgcaaacacaaacagcttgaccagaaaagacaagggcggagagggagcccctctccgcccttgctgtatacaattcgtcagttggcctcctgaatcaggaaggtctggttccccaccccgtccgcggatttctccacttccaggtcctcatgcgcctcctgcaccgccagctgcgcatccgtcataggctcccatgggataccggtactctccacaaaggcccgggcagcgtccggatcggctgtatgtgtgtccagcggcagggtgaacatgcagcccgtcacattgtcccgcagatccactgtgccgtcttctgccagggagaaacgctcataggagggggcggcgaatccctcatacagcgcgagatataccgtgtgatccgaaaatatctccaggctctgcgtgtccagtacataataggcccggccgtcccgcagaaaggaggagcaggcaccgttcagggtgaacacgttgacggcccggggatcatagccggacaccaggggcgtaacagtgaaggccccgcaggggaccacgtcatagttctcctctgtcaggggtgtgccgtccgtccggaccacggacaccacggcataggtgcggctttcctggacatcggcgcaccactgggagatgttggcgccgctgaccatccccatcagggtgacggtgtagtccccaacggtctgggtctcattgaggatcacggcggcttcgctttggaaggcctccgccaacattggatcgttcagttcctccgcaacctgggcgggggtcagccacagcacggcggcggacacagtcacggccaggagggccacggccgccgcagccagcagggtaatttttttcgtgcgattcatggacatcttgttctgctccttttcagatgcgtgccgcatggctgccagcttttgaagagtccgctcctcgaagtccggggagaagtccacggcgtcaaatgcggcgcggtagttctggcgattcattccacatcctcctttaaaagttggcgcagccgctcccgcccccgggagagtcgggtccccacggtagggagggggatttgcagcagcttggaaatctccttgatggaatagccctcataataatagaggtggatgacagcgctgtacttcgccggcagggcctgcacggcggaaaggatgggggagggctccggcatctctccgcctggaaggacctccgcggtctccagggggagattccgccgctccgccgcccgggccatgtcgcaggcccggtggagcgtggtgcggatcagccacgccttttcgtgctccaggtcccggaagtgcggccgggtggtcagcagcttcaaaaagacctcctgcaccacgtcttccgcgtcggcgggagaggacaggcgggtcatggcgatccgcagcagcatggggctgtacgcagccaccgtgcggcggatggattcgtcggtaccaaacgaagtcagggtcctcagctcctttcacccataacacggaccagcctgcccggattattcaccttccggaaaaatttgcaaagcccgttttctgcctgcgggagattgacagggagaagcggctgtgataatatgtaaaccaattatagcgtccctccgcactgcggtgggacttttttgggacacggtatgtcgaaaaaacaggaaaggaagcggatcatgggaaaaaaacgggtgtttgcggcgctgctggcgctggcagtgacagtggggtctctggtactgccggcccgggcggcctttaccgatacgacgggccactgggcggagaccgccatcacgaaatggagtgaggagtacagcatcatcaacggctatgaggacggcacattccggccggacaactccatcacccggggcgcctttgcgggcattctggaccgcttcctgaaattccaaagcacctcgcccgccgggacgttctctgatctgagcgggaactactgggaggatgccatcctgaagctccacgcctccggcgtttacctgggcaacaacgggcaggccctggccggggacaccatcacccgccagcaggcggtgaccatgatcgcacgggccttcaacatctcgggggagagcgcaacggtctattacctggatgcggaccaggtggcggattacgcgaagccgtatctggcggagatgtccgccctgggctacatcacggattcctccgacgggtacttccgtcccacggacgccatcacccgggcggagatcgtgacgatcctggacaacatgatcgaggtgctgatccagaccagcaccacctacacccaggacgtggagggcacggtgatggtcaacgcggcggagggggcctgcctccaggacatgaccatcacgggggatctgattctggcccccggcgtcaccgggacggtgaccctggagaacgtgaccatccagggcgcggtacggaacttcggcagcgccgtggtcacggacctctcccagcggccggaggagccggagcagccgccggccatccagcccggcgacgtgtacacgccctcggagaccacaggggagtatctgacatacagcaaccaacagatccccatctacgccggggtggagcggaaccgcttctcccagggagatttcatgtgggacccggaccgtccggaccgcctgatctataccggtgacgactaccggacccgcttcggcatcgacgtgtccgcctatcagaaccgggccagcgccaacaacaccatcgactgggaggccgccaaggccgacggcgtggagttcgccatggtgcggatcggcctgcggggctacggctccggcagcatcatggaggatgctttctacgcccagaatattgacggggccatggcggcgggcatcgagaccggcgtctacttcttcgcccaggccatcaccgtggaggaggccatcgaggaggcggactttgtcatcagcctgctggagggccacgagatcgacggccccgtggcctacgactgggagatgcacgacagcacctaccgggtctacggcaccacgccggagatggccaccgcctgcgcagtggcgttctgcgagcgcatcgaagaggccggctacgacgccatggtctacgccgggcagtatgtcagctacatcaaatatgaccagggcgctctggagccgtatctctcctggtaccccgagtacaagagcgagagctccgagcttctgtaccccaccctgtactatcacatggactactggcagtattccagcaagtgctctgtggccggtatcggcggcaacgtggatgtgaacctccagttcatccggcggtaagcccttctctccaaaagaaatacggcggggcgtctgccccgccgtatggcgattccaggggagttacttgcggttttccttctgggccttgttctggttctgctggctgttctcacggttctccttctgctgagtctggccggcatcgcgcttgttctggttgtcgcggttgctcatcaggacacctcctttcgcctgcttgagtacatggcatagtctcaccgccagctgcggaaattatacgcggaggctggaaaaaaccttgtcaccggaggaaaaaatggattgacaaaaggacaaaagggtgctatactaatccagcaaaacaaagaaggctgactgcatccgcctcacctccagcgatttggcaaagaggtttacactgctgtaatcagaccaccgggcggtggtttgttgttgcgcggatgcctgcatggtatccgcgttttgtgattctgagatggaggtgcttcgaccattagtaaagtagtgcatgaactgaacgaggagatcagagacaaggagattcgcctgatcggttccgagggcgagcagctcggcatcatgccccctgcggaagctttgaagatcgccgacgagcagggcctggacctggtcaagatctcgccgcaggccgttccccccgtgtgcaagctgatgaactacggcaagttccggttcgagcagagcaagcgggaaaaagaggccagaaaaaaccagcacgtggtggagatcaaagagattcggatgtctccgggcatcgacatcggggatttcaatacgaagctcaaaaacgcgcagaagttcatcgccgacggcaaccgcgtcaaggtctcggtccgattccgcggccgggagatggcccataccgacatcggtagggacctgctggaccggtttgccgcacaatgcgccgaaaccgccaatctggataagcccgccaagctggagggccggatgatgtccatcttcctctcccccaaatccggcaagtaatctgatttcaacgatacggaaggagcaaccattatgccgaagctgaagacccacagtggtgcaaagaagagatttaatctgaccaagaccggaaaggtcaagcgcgccaaggcctacaagagccatatcctgaccaagaaggataccaagcgcactcgtcgtctgcgtgccggcggctatgcggataccaccaatgtggatgccatccgcaagatgatcccctacaagtaagacacgagacgttcaaataggaggtttttgaaatggctagagtcaagggcgcgatgatgacgcgcaagagaagaaataagatcctgaagatggcgaagggctactggggctccaagtctaagcacttccgtgtggccaaccaggccgtgatgaagtccctgagctatgcctacaccggccgccggctgaagaagcgtgatttccgctccctgtggatcacccgcatctccgccgcctgcaagatgaacggcatgaactactccaccttcatgcacggcctgaaggtcgctggcattgagatcaaccggaagatgctggcggagatggctgtcaacgacgccgccgccttcacccagctgaccgagatcgccaagaaggcgtaagatccctttccagactatgtgagcagcgccctcccaaatgggagagcgctgctttttgtatatccaggacggaggggaggcaatccccgttgtgccccttcggtcaggctttccggcagaagtacggcccgcggtccgcctcatggggctgcgcaaacgtccaggtgaaatccttgtctaccacgtaccagtccgctccgggaatggcgcgtgcatctgcgggcagggtaaccagctcctccgccgtcaccggccgcaccagaggctcaccctccggcggctcttcataataaaagaggtatttctcaccggatgcctccgacagagcctgccgggccgcgtcgccggacaggcagggcaccaggttccaggagaagagatgccacaggtaattcccatccgacagcacatgcctccccaactccgcgtcggacacgccgtcggcaaaaacgtccagccagcggttcttcacccgccgaatgtcggtggggaagggttcctcccagggaaccatggtggccacacaccggcagatgggcagcccctgctcatggaacttggcctcgtagtccgtcatgacgcccaccgggccattcgcatggaggtcccgggtgacctcggacagctcaaagccgaacagaggcagctcctccacggagaaggtgaagaggtcctgattgtccgtcttgaagtggatctgcccgcccatcttcagcacctggcggtacagccgcaggaagttgccgtgggtcaggcggcgcttggcgtggcggttgctgggccagggatcgcagaaattgatatagatccggtccgcctctcccggggcaaagaacaggggcagctggtcagcattggcgtcgatgaagaacacgttggtgagcccctgggccgcacaccgctccatggccatgaccatggcatccggcacccgctccacagcgatgaacagcacgtccggctccgccgccgctgtgccggcggtgaagcggcctttgccgcagcccagctccagccgcagctcccgggcctggggcatcagctcccgccacttgcccggcatggagtagggctcccggatcaggcggtcgccgcagcgctccatccgggggatcagattctttttctttcgcatccgcatgtgtcaacatcctcctgggtcggttcccgatccgatttcaggaagaccccgccggggagtcctccgtacattcagaatgctattgtaccatacagacccggcgctgtaaatggcggcgtggatttcctgcttgcgcggaaagcaaagagatgatatgatagcccaaatgggaggggggagcgatgtgcccaaggtgccctactgcggcagaagcatgttttatcaggaggcgggcgagggcccggtcctgatctttctccatggcaataccgcctcatcccggctgtttgagccgttgcttccactctatacgcctcatttccggtgtgtgctgctggactttctgggaaacgggcgctccgaccgggtggagtcgtttccggcggacctgtggcaggaagaggctcggcaggccctggccctgatccgggcggcgggctatgagaggccctgtctgctgggaaccagcggcggcgcctgggccgccatgaacgcggccctgctggcacccggcgcagtaggcgccgtagtggcggacagctttgacgggcggagccttcacccggggtttgcgcgggatttgacagcagagcgggaccgcgccaaaagagacaaggcagcccgggaattttatgcatggtgccagggaccggactgggaggcggtggtggaccgggacacggatgccctgttgcgatgcgccgcctccggacggccgctgttctgcggcccgctggagcagatgcggccgccagtgctcctgatggggagccgggaggaccccatgtgcagacaggatttggaagaggaatacaaggcgatggcggcgcagatgccccatgccgccgtgcgcttgtttgcatccggtgggcaccctgccattctttcccgggcggaggcggctaaggaggagatcctggcattttggctccggtgcgaggcggccgagaggctgtgagatttccggcagatacaactggaacgaagggccttgtgaatgcattaacaaaattgtataaagtttaacgaacaatttgtatgaagtgtaaaaaacgtgaaatttttcgcaaactgcacaaattatacttgataaatgccgccagtcaccctataataaagtttgtgagtaaattggcaatatcggaatgactctgtgttctcccggaggggcggcacagcccggccccctggagtgccgaaaggcatgaaacaaggaaaccaaacaatttattcaaaaataacaggaggaaaaatcatgaaggttgcagtttttggcgcaggtaccatgggcagcggcattgcgcaggttttcgcggcaaagggccacaccgccctgatgtatgccagctccgtcgcttccgcgcagaagcacaaggataagctggctgcttccctgcagaagcgggtggagaagggcaagatgacccaggaggctgtggacgccctgctggccaacgtgctggtggaggagaagtccgcctgcgccgacgcggatctcatcatcgagtgcgtcaaggaagacatggctaccaagaaggagctgctgaatgagctggacggcctgtgcaagcccgaggccatcttcgcctccaacacctcttctctgtctatcaccgagatgggcaacggtctgaagcaccccgtcatcggtatgcacttcttcaatcccgtgcccagcatgaagctggtggagatcatccgcggcgccaacaccacccaggagaccttcgatttcgtctataagctgtcccaggagatcggcaaggagcccgtcgaagtggctgaggcccccggtttcgtggtcaacaagatcctgatccccatgataaatgaggccatcggcctggtagagaccggcgtcgcctccgtggccgacatcgacaaggccatgcagctgggcgccaaccatcccatgggccccctggctctgggcgacttcatcggcctggacgtgtgcctggccattatggagaccctgtacaatgagaccggcgactccaagtaccgtcccgcgctgctgctgcgcaagatggttcgcggcggcctgctgggcaagaagaccggcaagggcttctatgattattccaagtaattgaagtcagcaccaacaagaaaaggagttaatggtatatggattttcatctgacaaacgagcagcagatgctccggaagatgtaccgtgaattcgccgagaacgaagtgaagcctctggctgaggagatcgacgaagaggagcggttccccatggagaccgtcgagaagatggccaagctggggatgatgggtatttacttccccaaggagtacggcggcgccggcggcgacgttctgtcctacgccatgtgcgtggaggagctggccaaggtctgcggcaccactgctgttatcgtttctgcccacacttccctgtgctgcgcccccatctttgagcacggcaccgaggagcagaagcggaagtatctgcccgacctgctctccggcaagaagatcggtgccttcggcctgaccgagcccaacgccggcacagacgcctccggccagcagaccctggcggtgctggagggcgaccactacgtcctcaacggttccaagtgcttcatcaccaacggcaacgtggccgataccttcgtggtgttcgccatgactgacaagtccaagggcaaccacggcatctctgccttcatcgtggagaaggacttccccggcttctccaccggcaagcacgagaagaagatgggcatccgcggctcctccacctgcgacctgatctttgaggactgcatcgttcccaaggagaatctgctgggcaaagagggcaagggcttcaagatcgccatgcagaccctggacggcggccggatcggcatcgccgcgcaggccctgggcctgggcgagggcgctgtcaacgaggctgtcaagtacacgcaggagcgtgtccagttcggcaagcgcctgagccagttccagaacactcagttccagctggccgacatgcacacccggatgcaggctgctcagtacctggtgtacgctgctgccatgaagaagcagaatcacgaggactattccatggacgcctccatggcgaagctgttcgccgctgaggctgcctccgatgtcacgcgccgcgccgtccagctgttcggcggctacggctacacccgcgagtatcccgtggagcgcatgatgcgcgacgccaagatcaccgagatctacgagggtaccagcgaggtccagcggatggttatttccagccgcctgggcgtgaagtaagataggaggtaaaggttaacatgaaaatcattgtttccatcaagcaggttcccgacacctccggtaaggtggcggtgaatccggacggcaccctgaaccgtgcgtccatgcagaccatcaccaaccccgacgatatgaacgccctggaggcggccctgaagatcaaggacgccaccggctgcaaggttgttgtggtgaccatgggtccgcctcccgctgccggtatgctccgcgaggcgctggctatgggcgctgacgaggccgtgctggtgtccgcccgcgagttcggcggttccgatacatacgccacctctcagatcctggctgcggccatcaacaagatcggcgtagaggctgacgacatcgtcatgtgcggccggcaggccatcgatggcgacactgcccaggtgggtccccagattgccgagaagctgcatctgccccaggtgacctacgccgccgacatccagaaggacggcgacaccatcaccgtcaagcggatgctggaggacggctacatgaccatcaaggtcaagactccctgcctgatcacctgcatcaaggagctgaacgagccccgctatatgagcgtgggcggtgtgttcgaggcttacggcaagcccatgaccacctacgactatgaggcgctgaaggacgatcccctgatcgacgccaccaccatcggcctgaagggctctcccaccaacatcttcaagagcttcaccccgccccagaagggcgccggcatgatgctggagggcgccgacaaggcgacctgcgagaagctggccgacattctggcgaagaagcacatcatctgagaaaggggataaacgaatatgtctaatttcaacagcgccgatatcgctgctttcaaggatgtgtgggtcttctgcgagcagcgcgagggcaaactgatgcccaccgactttgagctgatctccaagggccgcgacttggccgacgagctgggtgtgaacctgtgcggcctgctgctgggaggcgagggcatcgagtccgctgccaaggagctgggcggctacggcgccgacaaggtgctggtgtgcgagagccccctgctggccgtctacaacaccgatgcctatgccaaggtgatctgcgacgtgatcgaggagctgaagcccgaggcgttcctgatcggcgccaccaacatcggccgtgacctggggccccgctgcgcggcccgtctgcacactggactgtgcgcggactgcacccacctggacgtggatgtggcgaactacatccagttcctgcgtgagtccagcaccctggacgtggacagccagaagtgggatatggaggaccggaacctgaagatgacccgtccggccttcggcggccacctgatggccaccatcatctgcccgcggttccgtccctgcatggcgacggtgcgccccggcgtgatgaagaagaacgtcttcgaccaggccaaggcggatgcgtgcgagatcgtgaagcccagtttccagctgagcgagagcgacctgaacaccgaggttgtggaggtcgtgaaggccgccaagaagctggtggacctgatcggcgcggactacatcgtgtctgtgggccgcggcatcagcaaggatgtcgagggcggcatcaagctggctgaggagctggcggacgtcctgggcggcgtcgtgggcggctcccgtgccaccatcgactccggctggctgtctgccgaccatcaggtgggccagaccggcaagacggtgcatccgaaggtgtacatcgccctgggcatctccggcgccatccagcacaaggccggtatgcaggactccgagtgcatcatcgcggtgaacaagaacgacactgcgcccatcttcgagattgccgactacggcatctgcggcgacctgttcaaggtcacccccatgctgatcgaggccatcaaggccgccaaggctgcgaagtaagcgaataaaagccaagagccgcacgggcaaagcccgtgcggctctgttctgtttgaacacctatgggggataccggcagttcaggactctgcgcgctcggcggcacaatccggatgctctgcgacaaactccgcctcagcctccgccaggatctttttgtctgccttggtggtgagttgggatttatcgaatttggcgaacaggtccggccgccgttccatagtgcgcttgtagctctgctttttccgccaggcagccaccttaccgtggtcaccggagagcaggatctccggcactgctcgaccgtgccattcagccgggcgggagtattggggatattccagcagcccgttccagtgggattcctcctcaaagcactccgcatccggcagaacgccgggcaccatgcggcacaccgcgtccgccaccgccatggcggggatctctccaccggtgaggacgaagtccccatgctgatctcctcgtccacacactcgtccaggaaccgctggtccacaccctcatagtggccgcagaccaggatcaagtggtcatatcgcgctttcagctccttggcaacttcctgggtgaaggtgcggccgcagggggagaggaagatcgtccgtccggggccgtaggtctccacgatgtggctccagcagcggtacaggggatctgcctgcatgacagcgccccggccgccgccgtagggatagtcgtccacctgcatctgcctgttggtggtgtattggcggatctggtggctctggatggagatatagcctcgctgctgggcccggcccaggatgctcacgttcagcatggcgtccactgagtctgggaacagcgtcatgatgtcaattctcatccgtggccatcccttcccaaacctggacctccatccggttggcgtccaggtccaccgatttgataaacacatccggcacggcggggatcagatactcccgcgctcccctgaccgtgtagaccttgtgagcgggataggagtccacccgggtgatctcgcccagcgtctcgccggtggcggcgtcacagacggtcatgcccagcagctccgcatcaaagcaggcgccctccggcagcttggcgtctgcccggcggatatacaggttcttacccttcagggccagggccgcgttcatatcatccacgccggggaacttcatcagcaccagggacttgtggacgtggttggcggtgggggtgacgggggccccgtccaaatagaacgtctggaactgggtcaggaaggcagggtcctggccgtccggctgtacccgcacctcgccccggatgccgtgggcgttgacgatgcggccgattttgatggtttccaatctcataggagcgctcctttgggaagtgatggcacgccgggccgtctccgacccggacaggaggcaggcgggccccgtaccctcctgcctgacaacgtttattggcttgtttctgtgtccgcccttcccagggcggaggcggggaacagagagatggtcccgttgtcgttgagatagcgcagcagggacagcaggatgggcaggccgaacaggcccacgatgccaaacaggtggttgcccacaaacatgctcatcagtgtcagcacaggatgcaggccgatctgtgcccccacgatccggggctcgatgatgttgcggatgacggtgatgatgacgtacagaaccagcagtgcgaaggcgtggggaagatctccgcccagcgcggagagaatgacccaggggatcatgatacctccggtgcccagaacggggagaatgtcgaaaatagcgatcagcagcgccaccagaatcgcacggttcacgccgatgagggtcagaccgacggatagttccacaaaggtgatggacatgatgagggcgtaggagcggatgcagacgaacagcgttcccaccacatacgccttgacctggagtaccagattccgggtgctcccctggaggcagcccaggcaaaaccgcacgatcttctggtagtcgacggcgatgaagaatgtggaaatcaccatcagcagcagccggatcaggaagccgggcagggaggtggcgaaagaggtggccatggacacaccgcccaccaatacgacggagagactggagaccaactgccacagcatattgagcagctgggactgcagctcctgcaacgcggacatgagggaggggtccagcttggccagcagctcctccagccaggcgaaaaagtcagtgagctccgggagaatataggcggaatagagcgagggaatctgctgcaccacagatgtgatagtggccgtgatccggattcccgccagcgccagcagcaggccgatggtgccgtatgtgaggaccaccagcagtaccgccaccaaccccttgggcgcgtggagcacccgggagaggaagcggatggggcggcgcagaacataggcgatcagaaacgccaagacgaacggcagcagtagcggcagcgcatactgcagcaacagataactcagcaccagaatcagcgctagataggtcacatcaatgatgaattttttctttttttctgtggacaccaaaagcctccaatcccacaggcagcgtcacctgacgcttgcggtgtagtacaagtaagcagtggaacgggctggccgaagcggcggggccgcagcccggacagcggcagcgaaatgatcgaaaaaggaggaggcctggcctcctcctttcggatctggcggaagcggcccgccggatgatcggttcaatctacaatatctacggaaaccttctggccggtgcgctgggcataggaccggatgacagtccggatctccttggcgatgcggccctgccggccgatgacctttcccatgtcgtcgggggcgacgcgcagctccagcgtcagctcctggggaccctccacctcagtgacagagacggcctccggatcatccacaaggtttctggcgatgtagagcagcaactctttcatgcccgatcctccggatcagaggacttctacttttttcagcagagctctgacggtgtcggtgggctgggcgccggacttgatccaggcctgggcgcgctccgtgtcgatcttgatctcagcaggggagacgcaggggttgtaagtgccgatctcctcgatgaagcggccgtcccgggggaaacgggagtccgctaccacaacgcggtagaaaggagccttcttggcgccaaggcggcgcagtctgattttcaccataatttgttacctccaacagtaaactcgaaattttttatctataaatgcatagcacttatatccactttatttcagccgcttcttgcgaccgaagccgtgcatccggctgcccaggccgccgcctcccattttggaaagccgtccccgggtcatctgcttggtcagctgctgcatcatatcgaactgcttcagcagccggttcacatccaccacctccaggccgcagccggcagcgatgcgctttttccggctggcgttcaggatctggggattctcccgctccagcggggtcatggagaggatgatggcctccgtgtgggccagggccttgtcatcgatggtggcaccggccatctggcggcccagagcaccgggcatcatgctggcgatctggctcaggtcacccatattccgcagctgctggagttgttcgtagtaatcctgcagcgtcaggcggtttttccggagcttttcctccagcttggcggcctgattttcgtcgtaggtctgctgggccttttcgatgaaggacagcatatcgcccatacccaaaatgcgggatgccatccggtccggatggaagggctcgatcatatccagcttctcgccggtacccacgaacttgatgggcttgccggtggaggcccgaatagagagagcagcgccgccacgggcgtcgccgtccagcttggtcagcaccacgccgtcgatgcccagcgcctcgtcaaaggcagtggcggcgttcaccgcatcctggccggtcatggcatccaccaccagcaggatctcattgggatggacggcagccttcatccgcttcagctcatccatcagggactcatccacatggagccggccggcggtgtccaggaagaccatatcactgccgtggtcccgggcatggcggattgcattctctgcaatctgcaccgggtcaccctgaccctgctcgaataccggcaggtccagctggccacccaccaccttcaattgctcgatggcggcgggacggtacacgtcgcaggcggccagcaggggccgcttgccaagctggcggcgcatcagccccgctagcttggcggtggtggtggtcttgccggcgccctgcaggcccaccatcatcacaacggtgggaccgctgttggccatggagagccgggcggtgccgccgcccatgagctttgtcagctcttcgttgacgatcttgatgacctgctgggcgggcgtgaggctgtccaacacgtcggaccccacagcccgctctgtcacggtagccacgaagtccttgaccaccttatagcctacgtcggcctccagcagggccagacggacttcccgcatggcctcccggacgtcgttctctgtcaggcggcccttgccccgcagcttcttgaatgttgcgttcagtttttcggtgagcccttcaaatgccatgcgatcattccttcaaagcggtggcttccgcgtgaatcaattccgccagctcagtcagacgggggtcctcatactggcggtagttgatggtcttcagctcggcggctgcatcctcgatggcctgcaaatggccccgcatctgctcgaagcgccggatcaggccggtcttgtcctccacctcctgcatgacgccctccgcccggacgatcacgtcccggacgccctggcgggagatgccggcgttttccgcgatctcagccagagacaggtcctcattgtaatagaggtcaaagaattccttctgccgctcggtgaggagttcgccgtaaaaatcgaagagcatggtcatgcggtatgtctgatttttcatgaactccctcatttctgtaaagctgtattcctttacaacgagaaatagtttacaggattttgccggaaaagtcaaggggaaaaacgaaagaaatccggaaaaaattcccctccggcagaccggaacggcttgccaaatccgcgtttgcggcatagactgagagggactgaacagaacggagggagtttatggtattcgacgcgcattcggatctgctgtacgatgtgacccggcggcgcctgctgggggagcggcgggtgctggagcaccaccatctggaccggctgcggcggggcggcgtggaggggctggtgctggccgtctgggccagcggtccccgagagacgttctggaaggacaccgcctggaaggatcctgcatccaatttgggccgcacccatcagatatttgcctgtgcccgggcagacctggcggaatgtccgcaaatccgcccggtccacaccgcagcggaggcagaggctgcccgggcagcgggccaaatctacgccttcctggcggtggagggcatggcggccatcggcgggaaccccgccggcgtggactggtactacggccagggcgcccggctggggatgctcacctggaacgagaccaatgccctggccgccggagccggaggcgatcctcaggcggggctgacggaggcgggacgccgggcggtgcgccggatgggagaactggggatggtggtggacgtgtcccatctgaacgacggcggcttctgggacgtgatggacctggccgccgggccggtgatcgcatcccactccaactgccgtgccctgtgcgatgtgcgccggaacctgtccgacgaccagctgcgccgcatccgggacaccggcggcgtggtggggctgaacgccttccacggctttgtccacgccgagccccggcagcagaccgccaggaccctggccctccacgccgtccacatggcggaggtcatgggggtggagcatgtgggctgcggcttcgacttctgcgagtttatgggccctggaaacgaggggcagagggcctggaaagcgccgcccacatccggaacctcttctactggctggaaaagctggggatgaaccggcaggagctggaaatggtcgcccggggcaattttctgcgggttctggcggggccagacctgccgccgcaatgagaaagacagctgctccccatcggagcagctgtctgattttctgcatcacggctgtgtgaagcctagatagcgggtgccctgaaaggtcaggcggcccgtgtccccttccaccaggagaccatactcccggccactgacggagaactccatccggtcaccgctctccacctgaaaggtgacatagtaccgggtggaggtggtcatgtgatgggtctcgcctccgtggtgatggtgggagacatcgatccgcttggccaccacagtggcctccaccgtcaaccgggggagttgttgttccggtgccactggctgacaccccggacgatcatcacaatgaagagacagagcaccagggcgaagatcagaaagaacaaaatttcgaatccgccgccgaacataaaggagtctaaaagccccatgccgccaaagccgggcgtggtcatgaagatcccaccttttcctcttgttgagactgattttaccagataccgcataagtcggcaagaaagaatttgaattatgggaagagatatactataataatcccatgttgtattccacagaagaggagttgagaccttggaaagaaccagaatccaactggccgacggggtgtatctcacctatctgccggccagaaagttcaagaccagcctgctctccgcccagttcgtcaccccgctgcagcaggagactgcctccgcttatgcgctgctgccggccatcctgcgccggggcacggtgcgctatcccgacctgggggcgttgtccgcccggctggaccggctgtacggtgcctctgtggactacaccgtccgcaagcagggcgagaatcagtgcgtaggcttcgtggccagctttatcgacgacagctacatccccggtggggaacagctgctggagccggtggcggagctgttgggagagctgctgtgcgatcccgtgaccgagcggggccgctttgtgaccgcttattttgagggggagaagaccaacctgattgacgccatccgcagccaggtgaatgacaagcgggagtatgcctacgcccgattgctgcgggagatgtgcgacggggagccctacggcatcagccgcctgggcgacgaggcgggtgcggagaagctgcagatgccaaagctccacgccctgtacggagagctgcttgccaccgccaggctggagctgttctactgcggcagcgcatccctggagcgggtacgggaggcgttggccgcagctttcgccacgttgcccagggatgggatccgggacatcgctccgtccacgccccatccggcccggaccgaggtgaagcgggtggaggaggccatggacgtgactcagggcaagctgggtatgggctttgcctgcggcagcgacgactacgccgccgcgctgatgggcaataccctgtttggcggcagcagcaactccaagctgtttttgaacgtgcgggagaagctgtccctgtgctactacgcctcgtccgcctaccaccggcagaagcggctcatcaccgtctcctccggcattgagttccagaactaccagaaggcctatgacgagatcatggcccagctggccgccgtgcaggctggccgcctggaggactgggagctggagggcgcccgcagtacgctgctgaatgcctacgcctccatgggagattcccaggggaagctggagaacttctacctgggccaggcggccaccggacaggaggacacgccggagctgctggcggagcaggtgcggcacgtgacggcggaacgcatctttgacgccatgcagaccgcctctctggatacggtgtacttcctgaagggaaaggagactgcggaatgaagcagacgttttacgagcggatcggcgagtccgtctaccgggaggtgctgcccaacggattgcaggtctgcgtggtccccaagccggagcacgccaagaagtacgccttctttgccacccggtacggcgggatggacacccgcttctgtctggacggtaagtggctggacacaccggcgggcatcgcccactatctggagcacaagatgttcgacaccaaggagggtaacgccctccaggagctggcgaaaaacggcgcggagcccaatgccttcacctccaacgccatgaccggctactacttcgactccacggagcactttgaggagaatctggagatcctgctgtccttcgtctctatcccctatttcacggaggagagcgtggccaaggagcagggcatcatcggccaggagatccgcatgatcgaggacaaccccgactggcagctctacacccggatgatgcaggccctgtaccagaagagcactgcccgcacctctatcgccgggacggtggagagtatctcccacatcacagcggagacgctgtacgactgccacaaggcattctacaccccctccaacatgattttgacagtggtgggcaacgtggatccggtccatgtggcggacctggcccggcggatcctaccccgggagggcgggcctgcgatcccccgggactacggccaggaacccgcccaggtggcggcaaaggagacccgcatggccatggaggtctctgcccctcagttcctgacggcctacaagtgcgccccggcggcggacggggaggactacctccgtaccgccgttctgggagacatggcctgcgacatcctgctgggggattccagccacctgtaccagcggctctatgaggagggggtcatcaacaccagcttcggcggcgcctttgagatgatgccgggcgtggcatacctctatgccggcggcgacagcaaggacgcccgccgggccgccgctgagatccagagggaggcggagcgcctggcagcggagggcatcgacgaggactattaccagcgggtgcgccgggcgtccttcggctccaacctccgggggctgaactcctttgagaacatcgccgtgaccctgacggaggggtatttccacggctatgatcccttccgcttcccccaggtgttcgactccatcaccaaagaggacgtggccgccttcctgcgccgcaatctgaccgcggagcgggctgtgctcagcgagatcgtgcctagggagaactgaatccaagacagagaaagagggggaaccccatttgagagcattacaggatatgcccatcagctttcccggcctgttcggggactggtccttcaatcccgaccctatcgccgtccatatcggccatgggatctactggtacggcatcattttggccatcggcctgctggcgggcctggtgctgtgcatgaagcaggccaagcgctacggcctgacagaggacaatgtgctggatatggtgctgtgggcggtgcccagctgcatcatcggcgcccgcctttactatgtgatcttctatctggacctctaccgcaacgccgatggcagcttaaactggggcgagatggtggcggtctgggacggcggcctagccatctacggcgcggtgattgccggggccatcgtggcatttttctacacccggcacaagaagatcaagatgggcgccatgacggacctggcggtgatgggcctgctgctgggccagtgcatcggccgctgggccaacttcatcaatcgggaggccttcggcgccgagaccacgctgccctggcggatgcgcctgtggaccagcgccacggagtatatcgaggtccatcccacgtttttctatgagagcctgtggaatctgatcgggcttctgctgatcctgctcgtggtctccaaagcccgccggttcgatggggagaacacctggttctacttcctgtggtacggcctgggccggttctggatcgaggggctgcggacggacagcctgtatctctttaactggacgttcctggggcagcccatccgggtgtctcaggcgctgagtctgcttctggcagtcaccgccgcggtgatgctgttctacaacatcaagatcaaaaagcactcgcgggatgagttgctggtgaatcaggtggcggcggaagccgtcgaggggacggcagaggcggatatttccacggcggaagcgggagagagtgtccctgccggacaggaggagccggagctcccccagccgccggagacccaaaacggggaagggggagagactgatggcaacacgcattgacggcaaggcgctggcggccaaggtcaaggcgcagacggcagaggcagcgaagtccctgtaccggcggccgggccttgcggtgatcctggtggggaatgaccccgcctcccgggtctatgtgaccgggaaggaaaaggactgcgccgagtgcggttttttgagctttgagcacgccctgccggaggacaccacacaggagacgctgctggacctgatccaggagctcaaccgcgacccgcaggtggacggcatcctgtgccagcttcctttgcccgggcatctggacgaggaggcggtgctgaacgccatcgcccgggacaaggacgtggattgcttccacccctataacgtgggccgcctgatgatcggtgatccggtgtttctgccatgcacccctgccggcgtcatggagatgctgcgggaatacggcatccccgtccggggcaggcggtgcgtggtgctgggccgcagcaatatcgtgggcaagcccatggccatgctgctgctccagcaggacggcaccgtgacggtctgccactccaagacgccgggactggcggccatcacccgggaggcggacatcctggtgtccgctgtgggccgggtgggtcttgtcacgccgggtatggtgaaggaaggggccgtggtcatcgacgtggccatgaaccggaacagcgagggcaggctctgcggcgatgtagacttcgccgcggtagaacccaaggcatcctacatcactccggtgcccggcggcgtggggcccatgacccgggccatgctgatgcgcaatatcctcaccgcagcccggaaccaccaggcggagaagtgaacagacgaaaagagcgccgcggcttttggccgcggcgctcttgatttgtatggggagaagctaccgttcctcccggaaatacgccagacccaggctggcggggggctgattctccttcttgttccgcagggagacaaaaatcagcaccgcgatggtcacgagatacggcagcatgttgaagaggtacgtgtcccgccggcccaggccggggatgatgaggtacacccagaacagcaggccgaacaggtaggagccccagatagcgttgactgtccgccaggtggcgaagatcaccagcgccacggccagccagcccagggactcgatggtgccgtcgttggcccaggtgcccttgatgtagtccatggtgtagtacaggccgccgagaccggagataccggcgcccacgcaggtggccaggtacttgttgcgggagacgttgatacccgccgcatcggctgtggcaggattctcacccacggatcgcaggttcaggcccggccgggtgcggttgaggaacagctgcagcaccacggccagcacaatggccagatataccatgaagccatagctgaacagcagccgcccaggaagccccaggtccgacaggccggggatggtggcccggtacacggcgctggtggcggctacggagatctggcccacgccgccggccatggagttcagggtgccgccgaagaagttggccacaccgccgccgaagatggtcagcgtcagaccggtgacgttctggttggcccggagggtgatggtcaggaaactgtacagcagaccgcccagggcggaggcggcgaacgccgccagcagagagatcaccagacacacgaaaccggagggatcgggattgttgaactcatagaagaaggaggccgccagtcccgcaataccgcccagatacatgatcccggggacgcccaggttcaggttgccggatttctctgtcaggatctcgcccatggcgccgaacagaatgacggtgccgaactggatagcagactgaatcagctgaacaatttggtcgacgctcatttggccccctcctttccgccccgcaggatgatgcggtagttgatgaaaaattcgctgcccagaatgaagaacaggatgatgcccgtaatgatattggaggcgtagtcattcaggttgaactgggaggcgatctgaatggcgcccttctgcagaaacaccagcaggaaggagatcaggatcatcacaaaggtgttgaactgagccagccaagccacgatgatggcggtgaagccacgtccgccggcggtggaggtggagatggtgtggctggcgccggccacggcgatgaagcctgccagaccgcagatggcgccggagatagccatggtgcggatggtgaccttcttcacgttgatgccggcgtaccgggcggtgttctcactgtcgcccaccacggagatctcatatccctgcttggaatatttcaggtacaggaacatccccaccgtcagcagcagcaccaggacaacattcaggccgtattcctggccgaacagctccgggaaccagccgtccttggtccgctggttgatgacgcccacggtattggagcccacgggattttcccacagggccacaaagtagctggtgagctggatggccacgtagttcatcatcagggtgaacagcgtttcattggtgttccacacagccttgaaggtggcgggcaccatgccccacgccgcaccagccagcaggctgaccaccgccatgatgaccagcagcaggggggtggagatatcgccgccgaaggcccgcataaacccggcggtgacgatgccgccgatgaggatctgtccctcggcgccgatgttccagaagcgcatcttgaaggcgggggccagccccacgccgatgcacagcagcatcatggcgtcccggacagtaacccagctgcgccggggggtgccgaaggcgccgtcaaagatgccctcgtacacctggaaggggttcagcttggtgacggcgaagatgaagatgccgctcacgaccagggacagcagcaccgcgatgatccggatggcccatgccttggggcgggcgatgccgtcccgcttggcgatgcggagcagaggctccctgtgggtcttaccctgtgtcatgcctccttcgcctcctttacaaagcgggtcatcagcaggcccacttcctctttggtggtggtgcggccgtccacaataccgctgacctggccgccgcagagcaccaggatccggtcgcacagctccagcagcacgtccaggtcctcgcccacatagatgacggccacgcctttcagcttctgcgccgtcagcaggttgtagatggtgtaggaggtgttgatgtccaggccccgcaccgcgtaggcggtcatcaacaccgagggattctgggcgatctcacgtcccaccagcaccttctgcacgttgccgccggagagccggcggaccggcgtgttgatgctgggggtcagcacatccagttcctccttcacccgctccgccagctggcggggcggcttgcggtccagcaggggtccccggccggaacggtaggtcttgagcatcatgttgtccgccatgcccatggaacccaccagtcccatgcctagccggtcctccggcacaaaggccatggacacgccgatgtcgtggatctgccggggattcttgcccagcagctcctcaccgcccttgtccaccggcacatgctgaccggcgatgggttcgtcgggggcggggggatgatagatgacgtgggacccgggctgggtaacccgcaggccggcgatggcctccagcagttccttctggccgctgccggagatgccggcaatgcccagaatctccccgccgtaggcgtcgaaggagacatggtccagagccttgatgctgtcgggagtcaggaccgtcagatccttcacctccagccgcaggttgcggtcctccaccaggggacggtcgatgttcagcgttaccgcatggcccaccatcatgtccgtcagcttctggggagaagtgtcgcaggtggccacgtccccgatatagcggcccttgcggagcaccgccacccggtcggacacgtccatgacctcgtggagcttgtgggtgatgatgaccagggccttgccgtctgccttcatattccgcatgacatcgaagagccggtccgtctcctggggggtcagcacggcggtgggctcatccaggatcaggatgtctgcgccccggtagaggaccttgatgatctccaccgtctgcttctccgacacggacatgtcgtagatcttcttgttgggatcaatggaaaaaccatatttctcactgatctccaggattttggcggaggcggccttcagatccagcttgcgctctccgtccagccccaggacgatgttttccgctgcggagaacacgtccaccagcttgaagtgctggtggatcatgccgatgccgcaggcaaaggcgtccttgggggaggcaatggtggtgggctcgccgttcaccaggatcttcccttcgtccgggaagtagatgccggccagcatattcatcagcgtggtcttgccgctgccgttctcccccagcagggagaggatttcgccccgcctgatctccagggagatatcgtcgttggcaaccaccttgccgaaccgctttgtgatgtgccgcagttcaatggcagtggtatgttccaaacagatcatcctttcttttagtgtcggttccgcgccatggccgcaggcacatgcctgcggcgcgggcctccggagggaaaagaaaagggaaaaaagaccccggcggccgatgccgcggaggggatggagcgatttgagagaaaggggctgccaaagggcagcccctttcgttggatatttagttgttgttcagctcagtgatgccgtcgatccgcagggagaagtacggagcggagcgcagcacggactcctggaaggcgccgtccacgatggcctcgccggtgtcgttgacaaagtcgccgtcgctgtccagaccgaacgcagatgtcacatgaccgtcggcgtccacctgataggacccgtcggcagcgggctggcaggtgaacttggaggtgtcgaacaccttcaggctgccgtccttgatgctggaccaagcggcgtccacggcctcctgggtgccctcggcgcactcaggccccagcttggagatcatcacagcgtcctcactgatgcccacggcatagtccacgggcacttcctcgccggcgatgaacttctccagggtgtcccggtacaggacggaccagttgttctgggaagaggtcagagcggcggtgggcgccacttccagcatatcaatgttgtagcccacagagtagaccacagagccggcatccttctgcgcctggacggcggagggggcaccggtggagtcggcgtgctggccgatgatgacgcagccgcgggccatcaaggcattggcggcctcgccctcagccacgggatcataccaggagttggtgtactggacctccatgtaggcctcgggaacctgggtctggatgcccagcaggaaagcggtgtagccacaaaccacctcggcatagggataggcacccacatagcccaccttgggatcggtgacggtgccggcgtccatcagctctttcagcttcatgccggccaccacgccggagacgtagcgggactcatatgtataggggaacaggttcttgtagttgtccagaccggaggtggcggccatgtcgccggtgcaggagacgaaggtaacgtcgggataatcctcggcggcatccagcatgtagctctggtggccataggagtcagagaagatgatattgcagccctcttccgccagatccacggcggcgtcatagcagttttcatcctccgcgatgttgtagcggaaaataacctgagaattggcatcaatacctaactcttcacaggcggcagtcaggccctcgatatgggccgcgtcataaccggagttgatgtcgtggacgcagatcaaaccgatcttgacatccgcggcgctgccgctggattcctcattggcggcggggtcttcggcggggctgccggtgctctcctcgtcggagccgccgcaggccgccaggctgagcgccatgaccagcgtcagcagcagtgcaaggaacttcttcattctactttcctccttaaaataaaattgggtggatcactgcaagggacaaagcggggtgtttcccctctctattgccatcatacagggtcaaacggaaaaattcaaccggatttttactttttttaggcggatagaccaaaaaaataccgacctaaataggtcgacctttggcagtgtgcacaataataagacgaaaaagacaaacaaggagagcgtttttttcgctctccttgtagaaaattgacagattgaccttttttggatcttacatggagacggcggtgccggtttttccggcgatgccgtccttggccttctccagcagggtgatgagggctgtgcggccgggcttggacgcggcgaacttcacggcagcctggaccttgggcagcatggagccgggggcgaactggccttccgcctcgtactgccgggcctcctccggcgtcaggtgatccagccacttctgatccggcttgccgaagttgatggccaccttctccacggcggtgaggatgatgagggcgtccgcgtccaggctctccgccagcagctcggaggcgaaatccttgtcgatgacggcgcctgcgcccttcaggtggttgccctccgtccggtagacggggataccgcctccgccgcagccaatgactacctggcccgcctccatcagcgtacggatggtctcgatctccacaatggctttgggtttgggagaggccacgcagcggcgccagccccggcctgcgtcctccatgacgcagttgccccggcggcgcatctcctccgcctcctcctcagtcataaaggtaccgatgggcttggagggattctggaaagccggatccgccgggtctacctccacctgggtgaggacggtggccacgggcttttggatgccgcggttcagcagttcctcccgcagggagttctgcaggtcatagccgatatacccctggctcatggcagtgcagacggacatgggggcgatgggatggctgtgatcctcccgggagagggtggtcatggcgatgttgatcatgcctacctgggggccgttgccgtgggccaccaccacctgatggccctcctgaatcaggtccacgatggccttggcggtgtgcttcacagcgaccatctgctccggcaggttgttgcccagggcgttgccgcccaaggcgataacgatacgtttgcccatagttggtgtatcccttcttcacaaatgatagtggtcgaacctatcagatagttttggcgggaacgcccgcgctattcccgccaaaacttgaaatttttagaacgatcagaacagcttccgcttgctgccctggtccagggccatcagcgcggagaccgggtccttcactttgctcatcaggatcatggccgcgatgatgtagggcttgtagctggcctccttgtacaggggcaccaggtaccggtcgaacacggagttgtccacctcgccctccgggcagctgaggccggtgatatcggcgggcaggcagtgcaggtacagggccttgccgttcttcgtccgcttcatcatctcttcggagcaggtccagtccttgtgctgggcgttctgggccagcagctgcttctccagagcgtcgatacccgcctggtcaccggcctgatacagcttggtccgctgctccatggcggcaaagggcgcccagctcttgggatagacgatgtcggcgccgtcgaaggcctcctccatggtggagaccttcttgtaggagccgccggtggccgccgcgttcttcttggcgatctcctccacctcgggcatcacatcatagccctcgggatgggccagcaccacgtccatgccgaaccgggtcatcaggccgatgacgccctggggcacggacaggggcttgccgtagctgggggagtaagcccaggtcatggcgatcttcttgcccttcaggttctccacaccgccgaactcatggatgatgtgcagcatgtccgccatgcactgggtggggtggtccacgtcgcactgcaggttcaccagggtgggctgctgttccagaatgccgtcccggtagccctccttcacggcatccatgaaggtcttctggtacttgtggccctcgccgatgaacatgtcatcccggataccgatgacgtcggccatgaaggagaccatgttggcggtctcgcggacggtctcgccgtgggcgatctggctcttcttctcgtccaggtcctggacggtcagacccagcaggttgcaggcggaggcgaaggagaaccgggtgcgggtggagttgtcccggaagatggagatgcccaggccggagtcaaagatccgggtggacttgttccgctcccgcaggtcccgcagggcgtcggccacggtgaagatggcctccagctcctcgtcggtcttgtcccaggtccagtagaagtcggacttgtacatgttgttgatgtgcagcttttccagatgcttggccagctcgatggtcttggacatattcagcactccttgtaatatgtgaaattgtagatgtatggcggctccgccgcagcgaaaggaaaaaccaggaaaagggtctagggaaaaacccaggtttttcccagttgatttgcctccggcaaatcaagcaaatcgaatcattttcgccgcggcgtgtacgtggcgaaaatgccttgacccagccccccttcgaagctcaccggatatcgttatccgtgaggctctgccggaactcggtgacgtcagcggtcttgttctcgggcttgtacaggccgggtactgcggcgtacagggcggcacaggtcaccagatcctgcttccaggtgatctcattgggggcatgagcctgggactcggcgccggggccaaagcccacgcaggggatgccatatcggccctggatggacacgcagttggtggagaaggtccacttgtcggtgaggggacggccctcccgcaggtgcatggcgtcccgcttctggtccgcgtcggcatggccgatgcgcttgtcgccccacagggcatggtgagcgtccaccagcgcctggacatgggcggcgctctccttgttgatccaggtggggaagaagcactccgtctcatagacctcgccggtccaggcgggccggtcatacatgtacatgctgaccttcacatcgtctccgtacttctggacggcgggcagctgccggatctcctccaggcaggagtcccaggtctcgccggcggtcatgcgccggtcgatggagatggcgcagctgtccgccacagcgcagcgggagggagaggtgtagaagatctggctgacggtgcaggtgccccggcccaggaactgggcgtcctcgtagtgctccggattgaattccggattcagcatcttcaccagacccttcacccggttggaggggccgtcgccgctctcgttcagggcccggacatcctggaggatgtcggccatcttgtagatggcgttgtcgccccgctccggcgcgctgccgtggcagctgacgcccttgacgtccacccggatctccatgcggccccggtggccccggtagatgccgccgtcggtgggttcggtagacaccacgaactcgatcttgctgcgggcgtcctcctgaccctggaagtccttgttgacgatgtactgccagcacatgccgtcgcagtcctcttcctggacggaacccaccaccatgatcttgtagccggcggggatcaggcccagatccttcatgatcttggcgccgtacacggcggaggccatgccgccctcctgatcgctgccgccccggccgaagatgacggcgtcgtcctcatagccctgataggggtcggcctcccagttgttgatgttgccgatgcccacggtgtcgatgtgggagtcgaaggcgatgatcttgtcgccgtcgcccatccagccgatgacgttgcccaggccgtcgatctccaccttgtcatagcccagcttctccatctccgccttgatgcagtggacaacctccttctcctcacagctctcgctggggtgagagatcatctctcgcaggaaccgggtcatgtcggcctgatagccttgggccgccgctttgatcgcttcaaaatccatatcgctgacctccatatcaatgtttggaatcccgtcatttccacatcacggattggcttacctatccctatcatagcataagaaaacaggatgtcaaacaaaaaatgagaaaacctaaaaatttttttgaatctccggcgcggaatgcgccgtccggccgaaatgattgcaaaaccaaagggcttgtgatatataatggtagagtaaaaagaacagcagatttgggatggggagagcttatgccgataccggaaaacgtggaaaacctgcggagagtttccgcaaagagcagcatttatcaagtggtatgcagctggatcatcacgggtgtgctgaagccgggagaaaagatcgttgattccgagcttgcgaagcgattcaatgtcagccggaccccggtgcgggaggccattcagatcctggagggacagaagctcgtctatgtggtgccgggccgggctacggtggtggcggatattgaccctgcggatattgaaaaatgctaccggacgctggcggagctgcagggactggcggcggagctggcctgcggcagcctcacggaccgggaactggagcagctggagcggattcacgccgcctttgtggatgcctgcggccgtaatgacggcaccgatgcgatcacgcaggacaacctcttccatgacgcgattgtccgcggggcacacaacgagtatgtggaggaattttcccacacgatgatcctccatatccagcggatcaaataccattatttccactgtgaccggctgcgaaagatttccgtttcccagcatggggaaatccttcagaccatccaggcccgggacagcgcccgcgcgaaggagctgatgcggagtcactggctctgctccatggaaaatagcctgcgggatgttgcgggcatgatccatggagccggcgcagaatccggacaggatgttctgacaaagtaaagatgggaagaaaaagccagagagaggacgcggagagaatccgggtcctctcaacgttttctgggcgaattccataaaattgtatccggcctctggtacgttccgtagaaatcctttggagaggccgggctttcgttgacttccacaagagtgcggttcataatgaatatgcgatatattacatattgcatataaagtatgacagaggttgagaaaggagcagagacatggacagagaccagcggctgattgcgttttgccaacaggctgttcgaatccccagtccctccgggcaggaacgggaagtggcccagctgatgaagcgcaagatggaagagtatggtttcgacgaggtgctcatcgacaggtatggcagcgtactgggccggatgcggggccgccggccgggaaagaccatccttctggatgggcacattgacaatgtggatgtgatcgacgccgacgagtggacccatgacccctttggcggcgaaatcgaccaggggcggatttacggccggggcacatcggatatgaagggcagcgtgacggccatgatctctgcggttgcccactttgccgaggacagcggccgcgactttgccggagagatttgtgtgtcctgcaccgttcatgaggagtgttttgagggggtctcctcccgggagattacccggctggcgaagccggactttgtcatcattggcgaagcgacgtccaccactgtcaagatcggccagagagggcgcgcggaggtggttgtggaaacagagggggtgagctgccattcctcgaatccggacaagggcgttaatgcggtctaccacatgatggctgtgatcgaggagatccgccggatcatccccaacgagcaccccattctgggaaaagggattctggagctgacagacatcatctcgtccccatatccgggcgcctcggtggtcccggccctctgccgggccaccttcgaccggcggaccctgacaggggagaacgaggccgtgattctcggccaggtggaggaggcaatcgcccgcgccagggaaaagatccccggcttgaaggcgcggacctatctggcagaggggaaggaggtctgctggaccggggaggccatcgccgcgaagcggtatttcccggcgtggctcattgatgaggacaatgaatatgtgcagaaggcgctggccggtctgaagaaagcgggaatcgaggcgccgatctctcacttctctttctgcacaaacggcagccacttctgtggcgaggcggggattccctgcatcggctacggcccctctttggagagcctggcccatgtgcgggatgaatacattgaaattgagcagctgacaaaggcatgcagaggcttcgccagcatcctccgggagctgacacagtagagcgcggactagaaatcacgaatttaaaaggaatggttatagcattggagtaaatctgattattattgataaggagaatggaccgtatggaacagattttgaaatcaatctccagctttctgtggggtgctccagtcctgatcctcctggccgccgttgggctgctgtttggatgtaagacaaaatttttccagtttcgcaagttcggctatattttaaagaatactgccggcgagatgtttaaaaaaggcggcggcgcaaaagggaaggaaggaacgctgacgccgctgcaggcggtgagctccgcgctggccggctgcgtaggaacggcgaacatcgcaggcgtggccaccgccatggtggtgggcggccctggcgccgtgttctggatgtgggtcgtcgccctgctgggaatgctgacgaaatgcgttgaggttacgctgggccagtactaccgtgtcaagggagaggacggcgtttattatggcggccccatgtactacattgagcggggaatgggcagaaagtggaaacccctggccgtcattttctctgtcactatcattttgggcggcctgggaaccgctgcgttcgcccagccctataccatgtccaccgctgtgcagaacagcctgggaattcccgcatggattaccaccgtggcggcggccgtcatctgcggcgtggttctgctgggcggcgtcaagtccatcggcggcttctgcgagaagctgacccccgccatgtgcctcatctatgtggtgggagtgctgggcgtgatcatcataaatctggaacatgtgcccgccgcctttgcggcgattttccgctatgcgtttgcacccatgcccgctgtgggcggtttggcgggctccacagttgcgctggcgctgcggcagggcgccgcccgcgggaccttctccaacgaagcgggctgcggctcatcgcccatcacccatgcgaccgccatcaccgatcacccctttaaggaggggatgtacggctgctttgaggtattcgtggatacgctggtggtatgcacgatgacagccctcggaattctctgcgcgggccctgaaatctggcagtccggcctggaggcggaggcgctgaccatggccgccttttccacagcgtacggcagcacggtcggcaagctcctggtcaccattcctctggcgttgttcgcattctccactatggtggggtgggagatcaattatgaatccgcgttcttctatttgtttcccaagggaaagcagtccaaggtgttcaagtacgccatccgcatcctgtggctggttcccggtttcctggctctggggaagacgccccaggtgatttggaccattgtggatatagtctcgggcttctggtgcatccccaacgccatcgcactgctggccctgtccggtgtgttcatgaggatttaccgggattatgagagcaaatacatcagcaagaccaagccggtctcccagccccttgagtatgtcgggaaggattgactgtcaggcggcgcttgggcgttgacaggccgcttccaagcgcagaaagctgtggacagagcatcaggcggcatccgcaaacgacgtggatgccgcctgatttttgggaccggcggagatcaaacacttttttcgcagacctaaaaaaatatttgctaaaacattgcaatctcggctggatgctggtatgatgcagatatgaatatcgctctggaaagtgagaaggtgatccccttggagagcaaccggctggagatgctcaagcagattgcagatgccttggcggcccagttcgggccaaactgtgaggttgtgattcacgatttgtccgcgcagaatgcggaacaccccattgtctatattgtcaacggccatgtcacaggccgcaaggtgggggacggggcctcctatgtcgtggtggagcagctgaccaccaatgacccggcgcctcgggaccatttggcctacctgacccggacgccggacggcaagatcctcaaatcctccacagtctatatccgtaacagcaagggcaaggtctccgccattctggccatcaactacgacatctccaagctgctgatggtggagagcgcggtccacgatctgatctccaccggcgaaccccagcaggaggaaccggagaaaatcgtcaacgtcaatgatctgctggaggagctgatccagcagtcggtgtccctggtgggcaagcccgtggccctgatgaacaaggaggacaaggtgcgggccatccgcttcctgaatcagaacggcgcgtttttggtgaccaagtccggcgacaagatcgccaagtatttcggcatctccaagtacactttgtattcctatatcgacacaaaacaacaggagggcaagtaagtatgattgatctgaccatcaacaagacgggcctggagcacaatctccgcaaggcgaaggaaaatcgcatcatcatccccaccatcgcccagatgcagcacccggagaccatcccggagaagatccgggagcggctgaagaccgtgggcctctgggatgtggatcccctgaacctgttccgcatcacctggaagaatgaggccaaggagagcggcggactgttccaggcggtgcccaactacatcgagctgcccccggcgctcaccggcgtcccctgccggatcgtggccatggtgggcaagtggttccccaccggctgccacaaggtgggcgcctccttcggctgcctggccccccgtctggtgaccggccagttcgacgtgaacaggcacaaggccgtgtggccctccaccggcaactactgccgcggcggcgccttcaactcccggctgctgggcgcccagggcgtggccatcctgccggcggagatgagccaggagcggtttgactggctccatgagatcggcgccgaggtcatcgccacccccggctgcgagtccaatgtgaaggagatcttcgacaagaccaacgagctgaagcaggatccccagtacatgatcttcaaccagttcgaggagatgggcaaccccctgtggcactacaatgtcaccggcaacgccctggcggatgtgtacgaggccatcaagcgccccggtgaccggttcgccggcgcggctttcacctctggctccgccggtaccatgagcgccggtgatctgctgaaggaaaagtatccccatctgaagctggcggtgggcgaggccctccagtgccctaccattctggaaaacggcttcggcggccaccggatcgagggcatcggcgataagcacatcccctggatccacaacgtgaagaacaccgacatggtcatcgacatcgacgatgaggacagccagcggctgctgcgcctgttcaacacccctgagggccaggcgtatttgaagaacgagctgcacctggacgacgagctgatcgagaagctcacctggctgggcatctccggcatcgccaacgtgctgtgctgcatcaagatggcgaaatactatgagttcaccgagcgggatgtggtgggcaccgtcctcaccgactccgccgtcatgtacggcagccgcatccaggagctgaacgaccggtatggcgcctacaatccccatgaggcggccatggaccatgcactccacatgctggggctgaagctggacaacatgcaggagctgacctatgcggaccgcaagcgggtccacaacctgaagtattacacctgggtggagcagcagggcaagaccgtggaggagctgaacgctctgtggtacgacacggagggcacctgggacaccgtccacgcgcaggccaaggacctggacgacctgatcaacgctttcaacgaggccaccgggctgctgaaagacctgtaaaacgccgcagggcggggcaaccgccccgccctgcttatttatgtctcctccgcgcggatataggcatcctcagcctcctgctgaatgcggaccagaatatcccaggcccggctggtctcctgctggtccagggccttcagagcgtcggcgatgccgttgaacaaaatcgtataatattgggggaaattttcgcgttccatatccgccacctccataatatgtattatattgcactataaattgtaatgcaatatgcaatattataaacgtgcgcataacgcaatacgattcgtcatataaaaatatggcgaggtgtgctatgcggaaattcaaaattcctaaaccagaatcaacaacgaacaaaacgattcgtttccccaacagcgttattgacgcggtagaggaggcgattcgtggaacagaatgtacgttttccgcctttgtgatcgaagctacccgggtggctcttgagaatcttctggaggaggaaacgtcaaaagaggagtaacgctatgaaacacgttttgtacggcaaatgcgtcaagtgcggcaagacctacgacgctgtgccggatctgaccaactgcgaatgcggcggcattctggacatcgtctacgattatgactacatcaggacccggctgacgaaggaaaagctggcggcccgacaggaccataccatgtggcgctaccgggagctgctgcctgtggaggaggacacgcccaacacccccctgcgggtgggctggagtcccctgtacgaggagccccgcctggcggagcagctgggcctgaagcgcctgtgggtaaaggacgacggccagaaccccaccgccagtctgaaggaccgggccagcgccatggcggtggccaaggcccgggaggcgggggcgaaggtgatcgcctgctcctccaccggcaatgccgccagctctctcgcgggcaacgccgcagcggcaggcctcaagacctacatcttcgtcccctcccgggctcccaagggcaaggtggcccagctgatgacctttggcgccacggtcatctccgtccagggcagctatgaggagacctttgaactgtccaagcaagccattgaccgctggggctggtacaaccgcaacgccgccatcaacccctacctctccgagggcaagaagaccgtggccctggagatcatggagcagctctcctggcaggtgccggactatatcgccatcagcgtcggcgacggctgcaccatcgccggcctctggaagggcctgaaagacctgtatgccattggcttcattgaccgcctgccccggctgatctccgcccaggcggagggctgctgccccatcaaccgggccattgcggagaacaagccctgggagcccatggaggagaacaccctggcggactccatcgccgtgggcgtgccccggaatgcggacaaggccctgacggcgatccgggagtcggacggcatcgtggtgaatgtctccgaccaggagatcatggccgcccagcagctgctgggccggacctgcggcgtgttcggagagcccgccggcgtcactggcgccgccggcgtgaagaagctctgcgagcagggcgtcatcggcaaggatgacacggtggtcagtgtggtcaccggcaacggcctcaaggacgtggccaacgccattaaggccgcgggagaacccatctccatcccttccgacatggaccgcctgctggtggcctttgcagaaaaaggcatcactgtggaataagcggcaaggggccggcgggagaccgccggccctttttctcgaaaaattttctgatccgcgcaacgatcctctcccgttttccgatgatataggtgaaagcagctttcataaagagagggactaccgtagcggatacggagaggaagcggggcgttcctccgggaagggcctgctgggcccggtcagcaggcggcacagagccttcttgacttttcccgcgcagattatataataatgtacggtgcctcccgggcaccatccacctgagggaatgagaaagaggaggcacctgatatgacgtatcccatgaccgtggcgggcctgcgccgggacctgcccatctgcaaagtgacggatgacctgtacatcggcgcgtttatcgtgttcggcgatgcggagctgactgtggcctgcgcccgggagcttttgaagctggtcccggcggaggactatgactacatgctgacggcggaggccaagagcatccccctgattcatgagatggcccgccagtccggtgcgaagaagtatttcatcgcacgaaagggtcctaaggcatatatgccggatcctatccacgtggaagacacctccatcaccaccgcgggaacccagcggctgtatctgggccgggacgatgcggagctgatccggggcaagcggatcctgctgatggacgatgtgatctccaccggcggttcccttcacgccatggaacagctggtggccctggcgggcggcaccgtcaccggccgggtggccgtcctggcggagggtgaggccgcagagcgcagtgacatcaaatttctggaaaagctgccggtgttccatgcagacggtactgtaaaagactgaagtgaagagagaccgggcgcgccgctgactcgcggcgcgcctttttccgcatacgcttgcaaaatcctggaagaatggtagaataaaggcacgatgaaaacgaagcatgtggtctattgacttccgcacgtcaacgcgccggcggcagtgcgctgcaccgccgccgtcaccggccgggtgccctccaggtgccgctgtggtttctgttcagcctgcctatgctgtaccacatcgtggtggaggaccggcagaaagtgggctggcctgtccatgactggctgccggaggccagcgccttgtgctgtatggaggtactgccgtactgttcgctggctatgcggcgccggtatccggcggaggggggagtacgtccgccgctttggggaccgggacgacggccacctgcttcggagcctgttctgcatcttcgctgtgtcgccctatctgatgaagacccggaacatcgcccaaaactatatccgggacgcagtggagatcgcccgagcagaacaggatatcacacagaagcgggcggcggggatggagcacttcggcctgctgcacgtgcggctggcggtctatgtgcgaacggacctgtgcccgggaccgggagatcgaggtgaacatgaccgtcaaaaaggagatgtccccggacacggtcatcaagctccggttcgacccatcggacacggcggacgtggtctatcagcggttcaatgccaaagtccaggaggtgaagaacgtcttggaggacacctccttcggtgcgctggccggcgcgttccatctggcgccgggtctgctgctgaaattcttggtgtgggccctgcaggtcagcgactacttcggctgcctgcccggatccatcacccatctctcgcacttccacgggtcgttgtacatcacatttatggcatcgctggggattccgcccattttccatcgcctgtacgatttcggcaatgtgccggtattctggtctttcggccggaagcggcaggcgtttgagtaccagtgggacggcacggtggcccggcggaggtaggtggacggctgcttcgtcacggacgagtggattgtggacggattctatttcgcggtcgccatgcacagttttcagaatctgatccacggtccctggcagctggacgagccgccggaggaggccgtgcaggatcagccctgatatagagaggaggtcgtttatgacggaccacaccgtaccgcccatcggaatgcggatgatcaaaaccgcggcggcagtgctgatctgcctgctggtgtccatggccgtggaccgggaggatatgcgcatctattcctccatcgcggcgctgctgtgcgttcagccctatgcggaagatacgaagcgcatggccatccagcggattgtgggcacagccatcggctctgtgttcggcatcgccacgctgctgctggagatggccctggatatccaggggactttggtgggctacatcgtcatcgctgcggtgaccgtgcccaacctgtggatcgccgtggtgctgaagtcctccaatgcggcggccctctcaggcatcgtgttcctcagcatcaccgtcacccatgtgacggatgccagcccctggatcttcgcctggtaccgggcgtcggagacgctggtgggcatcgcggtgggcatcgccgtcaacgccttccagctgccccgccggaagcggcgggacgtgctgttcgtctccggcctggacggcttgctgctgacggagcaggggacgctgacaccgtacagccgggtgagcctgaaccggatgctggacgacgggatgcagttcaccctgtccaccatgcgcacacccgcctctgtgcgggaggccacccgggacctgcggctccgcctgcccgtcatcgtcatggacggcgcggcgctgtacgacatggagaagaagcggtatctccatgcctgcgtcctgcccagggagctggccctgcggtgcgaggcggtgttccgggcccagggcatccactgctttctcaacggtgtactggatgataacctgatgatctactacggggaattccaccacgagacggagcgggcgatctttgagaagctgcggacatccccctaccggaattatgtgagcagaagctactacaaggattgccccattgtgtacctcatgggcattgatctgacggagcggatgcaggcgctgtatgacgcactgggggaggcgggcctgttggaacaggtgaaggtgcggttctaccctgcggcggagtatcccggatacagctacctgaagatctatgagcgatccgcctcacgtgaggccatgctggagcggctgaagcaggatctgggcatggagcggagcgtggtgctgacgacgcaggagggctgcggagacgtggtgatccgcggcggcgccaaccaggcggtgaagcggctggggcggctgtttgagccctatctctgggagcagaaataacacggacggagctgcggctccgtccgtgttttgcattcggaaagaaaaccggagcagggacttgacaagtgtggaagcctgtgtataatatgaagtatccttcatgtgaaagacgcttcacgagaagggaccttcacatttatggaaaggggagagagaccatgaaaaaccgtgtacgggagctccggaccgaggcaggcatgacccagcagcagctggcggatctggtccacgtgtcctcccgcaccatcatctccctggagaaggggcagtacaacccgtccctgctgctggcgtaccgactggcgctggtgttccgcaccacggtggaggacctgtactgcctggcggagaacaaggaacaggaggaccgggaaaatgaggaatggacataagggccgtatggcctgcggaattctggaactgatgctgggcgtggggctgatcttgtacatctgtctggcggaccggcagcggattggtctggctgcggtggccgcggtggtggtgacggcgggacttgtgaccttctgtaccggtgcaacggcggttccggcgaagcgtaaggaggaaactgtgcaatgagaatttattacaaaaagaaattttgggccggcgtgggagctctgctgctgggcctggccctgccgggcacctgtttgttcgtgggctgggagcggttcgacctgaaggacgccgtgctgacaacgttcatggtcctcagcggaatcagcggcattctccggagcctggaccgggagaaggcccggcaggaccgggacgaggaccgggacgagcgcacccggtacaacacgtaccgcagccgggccctcacgttccgggtgctgttttgcctgaacttcgtcatactggccgggtgcttcatcggttggtggcggtcaggtgaacaggaagtctacatccagacggctgttccctgcatggtgctgtttatcgtgggctggatcacccggatcgccagcgatttctactatgagttcaaggggtgaaaatgagatgcgcatttataataagcggaattttgctgccgggatcctcagtctggctctggcggtggcttgcggcgtggtcctggcggtgacgggattccagacgaaatggctgatcgccctggtgctcctgctggccgctggcggcttcgatctgtggtggtctctgtcccgggagtccaggctcccgcgggtggatgagcgggaccaggccgtcagccggaaaagcgcctggctggcctaccggattgtggctaacggctgctggatcgtgagtcttgcggccctggtggtctatggaatcagccggatcccggcagctctggcggtgaccatcacgctggacgctgtgaccatcggggcttttgccgccctacagggggctgaagtctactatgaaaaacggatgtgaggccgccggccctctggaaaaggagaacgtatggatcgaagcgaagatttgaaacaggtgcgggacctgcatctggtccgggatgagcgggacagggaggtggaggcggccgccggactccgggcgggaaacgcggtggtgctggtgagccagctgctctccgccgtctgcctgctccaggatgatccggcctggatggcgctgctgtccctgacgctcgtctgggggggcgtgaagggcttctggcgattcagacaggaccaggagaggatctatttggtgtggggcctgctgacctgcgccggagcggcggcgctgctgggactctatttccaccgggcctggtctgccgggatgtcgttcaccagactgctgggctacgcagtgctgtgccaggtgctgacggtggccgccggactgttatttgtggcgctgctgctgggtatcttctggctggcccacaagctagggcatatagagggagagcgttgggagcagtatttccagtccgtgtccaccgccggacttctgctgcgggtgggtgctgtgatggcggtggccctggcagcggtggcggccctcagcgttcccctgttcgcccggttgggctttcaggagccgggacttctggccgcgctgttttttgtggcaaggggcgcgtacctgcttaacaaattcagccgccggcgggacgaactgatccagaagctcctgaagctgaaacgctgagctgcttcagcctggtgaagcggcacgggggcagacttgtacaacctgccggaatctctcggtgtttgcagggagaattttctccagaggtgcctattatgcggactgccgtgagatgctatcataaaatggaaatcccatcgtggaaaaacaaatactgagatagaaataagtccgctgggcgtagtctatggagcgataggctgcgccctctttttctgctcaggacaaggagtgtttcgatcatcatgccaaaaacaactgtacagaaagtgatcttcggtctgctgatgtcctttttcatggtgctggccatggagatgtacaacacaggcctgcggaacggcggtcttacaaacgccgggatcctgaacgccctgcgggagctgccgctgatgtttgcgctgtgcttcctgaccagcacagttgtcggagaacccctggccgcccgcctggcggcacggctggcagtgccccgggagtggccctttgccgccgttctggcccggtccgccatgacggtgtgcgtcatgtgtccggccatgagcctatgggctacggtgatcttccagcagccggggatcgagttggtgccctcctggctccagacggtggtctgcaattttcccatggcgtttttctggcagatctttttctgcggtccgctggtgcggcggctgttccggctgctggtgccctccgcggcgcttgtacccgcctgtgcggaagaggcggcggaatgagggacatgtgcaagcggtcccggacgctggtacgtccgggaccgcttgccattatccctccgggtgcgtttttaaataggtgaggtagccctctagaatcagcgatgccgccacagcgtccaccacctttttccgcttcttggcgttcttgccgctgctcatcaggatctggtgagcgtcgatggtggtgcgccgctcgtcccacaggaccaccggcaggccggtggtctccttcagcagctgccgcatggcctgggccttttccgagcggggcccgcgggtgccgtccatgttgatgggatgccccagcaccagccgttccaccctgtgctcctttgccagaagtgcgatctgtcccgtcacccggtccgggcggtaggcgttgatgacggtggtgaagccggccagcaggccggtggggtcggagatggcgatgccggtgtgggcgtcgccgtagtcgatggccatgatgcgcatggtggtctcctttccagggaagaataaacgccggtatggcgcgttttgcctgcccacaggataccacatcggggcaggccgcgcaaggcggaaaaaacctgacatttttttcaaaaagaggttgaccggcgccttgacctgtgttacaatcattcttacctgtgaaaaagggttttcttttcatgcgcttttttcgcttttcagccatggaggtctgcccgccaagctgcagggaggcaatcgggactctcccggtccgccggagagagagccccaataataaggaggtgccgttagatgcgcgtgaaggtcactttgagatgcaacgagtgcaagcagagaaactacaacaccatgaagaacaagaagaacactccggacaagctggaactcaacaagtactgccccttctgcaagaagcacacgctccataccgagactaagtaaacggtcacgaatgatgagaaagggcgtgtaaacgttatggcagaagaagtcaagaagaaaagaagccgcggtcagtggttccgcgaaatgaaaagcgaactgaagaaggtcgtctggcctgaccggaagaccgtgatgaaaaacaccggcaccgtgctgctgtgctccttggccatcggcgtgtgcatctggatctttgactttgtcatggtcaccgctgtccagatgattctcagcctgttcgcctgattgaggtagaaacatgtcagagagcgcgaagtggtatgtggtgcatacctattccggctacgagaacgccgttaagaccagcattgaaaagttcgtcacaggccgcggaatggaggacatgatcctgcggatcgaggtccccatggagacggtgacagaggtcacggactctggcgccaccaaagaggtggaacggaaggtattccccggctacgtgctgatcaagatggtcatgactgacgatacctggcatctggtgcggaacgtccgcggcgtcaccggcttcgtgggctccgccaacaaagccatccccctcacggaggaggaggttctggccatgggcatggaaaagcatgagatcgtggtcagatacaatgtgggcgaccatgtgaagatcgtggatggcccactggccagctttaccggcgtggtggaggagatcgagcccgagaagaatcgggtcagcgtgatggtctccatgttcggccgcgagactccggtggagctggagctggaccaggtcgaggtccaggactgatcgaatatctgccgggcgccccagggcgccggcccgccggacattccggcggaaaagtgggaggggctgaactgccccgccaaagacggccccgtgccgccaccacattcatagatttaggaggtgctactccgtggcacagaagattactggttatgtgaaactgcagatccccgcaggcaaggcaactcccgcgccccccgttggtcccgctctgggccagcacggcgtgaacatcgccgccttcaccaaggagttcaacgagcgtaccaagaacgacatgggcatgattatccccgtggtcatcactgtgtatgctgaccgctccttctccttcatcaccaagacgccccccgcggccgtcctgatcaagaaggagtgcaacatcgagtccggctccggcgtgcccaacaagaccaaggtggccaccatctccaaggcctccatccagaagattgctgagatcaagatgaaggacctgaatgcggccagcctggagtccgccatgagcatgatcgccggcacctgccggtccatgggcgtcgtcgtcggcgactgagcccggctttcacagaccgtttcaaacagcgagcggcccgtggggccgcaccatacagtgggaggattcatttccgaagaaccactatgaggaggaagtaacattgtttagaggcaagaaatataaggaaagtgccaagcagatcgacaagaccatgctgtacgacgctgctgacggcatggcgctgatctgcaagactgccagcgccaagtttgacgagaccgttgagctccatgtgaagctgggcgtggactcccgtcacgctgaccagcaggtccgcggcgccatcgtgctgccccacggcaccggcaagaccgtccgggtcctggtgttcgccaagggcgacaaggccgacgctgcccgggaggccggcgcggattacgtgggcgagatggatatggtggagaagatccagaaggaaaactggttcgacttcgacgtggttgttgccagccccgacatgatgggcctggtgggccgcctcggtaaggtcctgggccccaagggcctgatgccctcccccaaggccggcaccgtcacccccgacgtggccaaggccgtgcaggaggtcaaggccggtaagatcgagtaccgcctggacaagaccaacatcatccactgccccatcggcaaggtgtccttcggccccgagaagctgactgagaactataacgcgctgatgggcgccatcgtgaaggcgaagcctgcctccgccaagggccagtatattcgcagctgtgtagccgcgtccaccatgggccccggcgtgaagatgaacacggcgaagatgatctgaggctgttcggaggggagctggctctcctccgaacaccccatcgccgcgtcaaaacaaactgcgcttcatccgtttctgcctgtggtgaaaccggatactgctccgtttgtttttccttttccgacaaaagctgggcttttgttggggcccgacgtggtcactggcgtgcgcaccccggtgcgcgggacgatgaattttcgccgcacacatgttgcggcaaaatgattcggttttcgtcttccgctgcaggcggaagaaccggaaaaaaccggaggtttttccgggcatttttcccggtcctgtgggatctggggaaatctgttatttagttcttgacaaatcgtcgagaattaaatataataccagatgcgttccaaagacagcaggtggcatgagccataaatcctgccgagggcggcaaacttgatttgctatccgtccctgtgtctttgcgcacagggacggttcctttttttgaacgcaccgacaattttcctggaggtgaacactagaatgcctaacgcaaaggtcttatctgaaaagcaggccatcgtggccgagctgactgagaagatccagaaagcttccgccggcgtgctcgtggattacaagggcatcaccgttgaggaggacaccgcgctgcgcagagagtgccgggagaacggcgtcgattacgccgttgtcaagaacaccctgctccgctttgccttcaacaacaccggcctgaacgagctggacgatctgctcaacggcaccacgtctctggctctgtgtgaggaggatgtagtcgctcccgcccgcgtcatgagcgactatgccaagaagctgaacgacaagttcgagatcaagggcggctttatggacggcaagcccgtctctctggagaccatccagtctctggcttccatccccgctctgcccgttctgcgcgcccagttcctgggtactatgctggctcccattaccggtctggctgtggtcctgaagcagatcgccgaaaagggcggcgagcccgtggctgtcgctgccgaggaagctgcccccgccgctgagtaattgaggcggcaagttcttacttttaaattttacaattaggaggctattacaatgtctgagaaagttaccgctatgatcgaagagatcaagggcctgaccgttctggagctgagcgagctggtgcacgctctggaggaggagttcggcgtgtccgccgccgctatggctgctcccgctgccggcgctgccgctcccgccgctgaggagaagacctccttcgacgtggtcctgaccggcttcgacgccgctgccaagatcaaggtcattaaggttgtccgcgagatcaccggccagggcctggccgaggccaaggctactgtcgagggcgctcccaagaccctgaaggagggtgcttccaaggaggacgccgaggctctgaaggctcagctggaagaggctggcgccaaggtcgagctgaagtaatcgaacttccatacttgggcttctgccttttatcctaggcagattctccctggaatattgacccgatgatgaaattgggcctgaggtaatttacgttaccttgggcccttttttgtgccctgaaacagaagatatgggtactcaagccgttttccgaaacaaatcaaaataaaatctcttcacaccatcctgtcaaaatttgagggagaatgcggcaagaattgaagggagagacacaatactggagagaaattccctgtccaatggacgtggaatttaacccaaaagctccccatgcccttggaaggcatggggagcttttgggttaaattcatgcagaactctgcgataatcctataacttttatatacatttgtagattccacattgtcggttttgcattttccactccccctagagagcattgcccactaacatttatgactttgaggctgtattcatttaataatatctgttgaatgtcttgaacagaaatctcgccgtccgcgatctcttcattcatagccgcccgttgaagcacaattcggagttcctccgaagaaagaattcttttccgaatcattggctctgcgatggttgcaaatgccgcagagacagcaattgtggttatcgtgcggataaaatgcgtcaaatctccctcggtatgaatcacagaggagggtcactggagcgataaagagacaccagtcagctcccggatcttaacaagctcctgctccctgattttctccagatcataattcttaggactgattggaatccgattggggttaatcttctttcgctttatggcaaacgctccgctatttctttggagtatttttgactatttctgtgacggccttaatttaacaatatatagaaatggaaagaatgcttgacgcggcagccgtcaaaggtatacatacagcatctgactgatttaaaacggcacttatttcaggaagcagacaaatctgtccaatcgcatttcggccagcagttccgttatcatagatatagaggccttgctctccggtaaaacatccatgcagaccttttctgcttgagtctcgtccctcttgcacagttccatccaaatcacacccttcctcaaaattttttcatgataccacatttgaggaatgagcgcaagggctcgcccatctcagcgggaaaagacagcattcaggaataaagtgcaacacattaaagcgtgcggcgaactggtttgcatagccgatgaagaatgagtccttttgaagaagaagcacaggactatatggatacggcaaaagggttagcagagagtataaaggaataatctgctgactgctatttaacaactatttgtaaaaaggcccggaggcattgcatcgcaatgcctccgagtcttgcctgcaaatactgcaaaaattgtgcaatcccactgaaacacttgtgtcccaataggttttccttttctggagttggctcccggagaatgcagctaatgaggcagcgacattttggcctatctcatcaaaaaatataaacttgggaaaacttctaggacgcagagggttacctaccctaagattttcttccaaagactccgttattttgatgcaaatgaaggcatcaatccgataatggtagactttatctataaaaatttcatgatatctttacacaatttgcatgttcccaaaatgaagttgcgaagcagagtttttcgtgatatactgaaaaatacaaaaattgctaatataacagacaccttgatgataaacaccaacctcaacagcatattcttggggagctttatcggttctaaacgagtgtgttccgagagaggaaggaaagagaggtgttcttagtgaagaaaacagaaaggatacctttcaaaatgagcaaacctcagcagttgtcggagaaatatacgaaggagattttccaagagatcaagtccggcatatattctcgggcagaccgtcttccctcggaaccagatatcgcaaagcactttggcatcagccggaccatggtgagggactgcctttctacactggaacgggagggatttatcagccgtaagcatgggattggtactattatcaatcagcatgtgttggatgtgaaggtgcggttggatctggaagaggaatttctggatatgattcgctccgctggctatatacctggtgtggcatttgtccgtaatgcgatggggaaagcagatgttcgtacagcgcagaagcttggaattaaagcgggggaggatgtagtaatcagtgtccgcctaattacagctgatggtgcgccagcaatctattgcgtagaccacattgcgcgtcggagtatcgtcgcaaaagaatatgacctttcgcttttggacagtcctgtatttgagtttgtggaacaatattgcggcacagagatttatatggacctatctgaaattagtgctgtggctgcggatgcagagcgggccgatgtgtttcagatcccacagggctctccgcttttgtacatcgatgaactgggatacaattttgtgggtcaacccattttgtattctcaggagtattacgcaaacggcatcttcaagcacacaattctgcgaaaaaaaatataaataccccagagttttgtgagagttcgagaaaatcggctctcttttttttcgcaaaagtgcattgatttggtggtgccgctttgatactataaatgtatatctatttgtattacaaatagatactacaaaaatgggggtgctaaaatggcaaaagaaacacagcttgtaaacagcggttcttttctggaaaagagattccatctcaaggaaaaccacaccaatgtgagaactgagatcattgctggattgactacgttcttgacctgtacctatattttggcggtaaatccggcgattctgtcctcaacaggaatggattccaaggcggtactatgggcgacggctatctcggcagctatcgcctgcatcgcaatgggccttttgactaattttccttttgccttagcgcctgccatgggactcaacgcatattttgcctacacagtctgcggtacgctggggctgtcatggcaaaatgccctggcctgtgtgtttgtggaaggtgttaccttcagtatcctcagcgttgcaggtgtacaggagcgcattgttaacggcattccagagtgcgttaagcaggctatttctgcggctatcggctttttcattgcattctcggggctgcataattctggtatcatagcctatgaccctgataatttgctgtgcctgggcaatttgcaggatcccggtgtcattctggctctattggggattctcctgacagcgggactggttattatgagggtcaaaggcgccatcctcatagggatattggctattacctttgcaggtatgctttttgaaaacccggctacaggtgctacctatacccaatggcagggtctggtctctttggaaaaccccattgaggcgctagcacctacctttggacaactgacatttgatggcctgtttgggggcggtgtggcggctatcattggtgttctctttgccatttttagttttttgtttgtggatatgttcgacagtatcggcgtgctggtaggtgtgggaatcaaggctggttttgtcaacgaaaagggtgaactgcccggcgcgggcaaagctctgtttgtgtctgcagcaggggctgcagtaggagctgtgttcggcacccagaccgtcacggtgtttggtgcagagagtaccacaggtattgctgagggcggaagaacaggtcttactgccattaccacaggggtgttctttctgctgtcgctgctcttcaccccgctgtttttgatgatccccagtattgccaccgccccggcactggttatggtgggtatctttatgattgagccgctgatgcatgtggacttgagtgataccaagactgctttcccggtattcatctgcgtggcttttatggcgtttaccttcaatatcgcctatggtatcctcttcggactgctggcttacactggcggacaggtctttgctggcaatgctagaaagctcccgatttccacttggatactgacaggcgtgttcctactgtatctgcttttggaaatcttttttaactgaggcccggcaggacgattcatcgggagtacatttcaatcaagtttccgaaaaacgggcaggggcttccaatccgattgtgggagggagtcctttgccctagaattggagaaaagcacatggggatcaaaaatagcattccgcgtctagacgctgtggataaggtgaccggcgcggcaaagtatacagaggatcttattcctattaatgcactggtgggaaagactcttcacagcaccattgcaaatggaacagtacgcgctattgatgtggacgaggcgtggaagatcccgggcgtagtggatattttaacttgttttgatgtgccggactgggagtatgcgacctgtggacatccgctttccctggatcccgcacataccgatgtggccaacaagcgaatactgaccaaacgagtgcgctactatggagatgagattgccgcagtggtagcagaaagcgatctggcggctcagaaggcactggaggctatccgggtagagtacgaagaactgccgccgctgctgacaccggaggctgctgtgatcagtgggattcctctgcatgaaaaatccccggataatcagggggggcgcatggattttatcattgatgagagccaaaatgtccggttttatcagggaacgttctccatggatccatgtatcggcggctatgtcgatttacgaggaacaaaatttcatgtaccggcccagcaacattgccatattgaaaacatctgttgctttgcctatatgagcgggcggaaaattgtagtggtgtcgcccaatcaggcaccccacaccctacgcaaacatatttccgatgctctgggtatccccacaggccggattcgtgtggtcaagccctatgtgggcggagcattcggcaataagcaggatatgttctatgagccgctggcggctttattcaccttacggctgggaggacggtgcgtggcctttgtgatgagccgggaggagacatttgtcaatagccggactcgtcatgccatggacatctgggcggcggcctgtgtggatgatacgggacgaatcacgcagaagggcattcgcctgaatgcatacagcggcgcgtacggttctaacggccacgctgtggccgcctatgcggtgactaactatttccagctttatcctgctttgggcaagcaggtgggagagtccgctacggtctataccaatatgccctcggcgggagctatgcggggctatgggattccacaggtggcctttgcgatggagtgccagatggatgatctggcactgaggtatcatttggatcctgtggaatttcgaaaaaagaatatgatgggcctgcatttcttggatccctttgaccggtttctctgtgccagcaacggtctggaacggtgcatcgaccgtgggtgtgagttggtggactggcaagcgaagcgtcaggcgtatgatgcgttcaaccatacatcgtccaatctcaagaaaggattgggcatggcagtgtttgcctataagactggggtctatcccatacaattggagacagcttcctgtcggatgctgctcaatgatgacggcagcctacagatacaggtctgtgctacggagctgggacagggctccgatactgtatttgcccaaatcgcctcggagattaccacaattccggaagagaacgtgtatgtagtctcctgccaggatacggatgtttctccccatgatgcgggggcatacgcttctcgccagacttatgtctccggcagtgcggtgaagcagacagcagagatacttcggaagaaaatcctgaacagggctgcctgtttgtacgaagcagattccaaagatcttgcccttgatggcggacggattacaggccgtgatggcgcagtcctggggacggtgagggatgtggcagtccgaatgcagtacaccaacagcacaaagataaacagcgaacatctgacggcggaatccacctacaccatgcgtcataacgcatttgccttcggtgcaagctttgttgatttagaggtggatgttcctatcggcaagattaaaatcaaccgcgtgatagcgattcacgacagcggccagattctcaatccggcgcttgctagagctcaggttcacggtggtgtggctatggggattggatatgctttgacggagcagatgctttttgaccccgagactggtaagatgcgaaacgacaacctgttggactataaaatcccgacagccatggacatcccacagattgatgtggagtttgtggagacctatgagccctccgccccctttgggaacaaagcattgggagagccgcccatgatcccacaggcaccggctatccggaacgctgtgctccatgccacgggcgtggccgtctatgagctgcccctgacaccggagcggctgatccacgcctttatacaagctggactgatacaaccactgtcgtgcgagcatatagcggagacataagcgggaggtatacgctatgtatgatattcgacaagtttatcagccaaaggacctgggagaggcactctcacttctggcagaacatccggatgccattgttatctccggcggaacggatgttttaatcaaggttcgggagcggaagtggaaagactgctctctgctgagtattcaccgcctgccgcagcttcagggtgtgcgccgggagaaggaagaactggtggtagggccgggtacctgctttgaccaactccatgaaactggagtgattcgggagcacgccttttgcttgtggcaggcggctgaccaggtggggagcccccagattcgcactgtggctacgctgggagggaatatctgtaatggcgcagtcagtgctgacagtgcgccgccgctgctggtactcaatgctaggctggaactcaccgatatcagccaaaccaagcggcaactggatatcggtgcgttttatactggtcccggacgcacggccttggaccgaaaaagggaactgctgacggcggtgcggattcctataatccggccgggatgcggcagctattacatcaagtatggaaagcgcaatgccctggagatttccactttgggttgcgcggcgtatgtggagctagatgcggggaaaaagacctttcgggaagtgcggatcgcttttggtgtggcggcgccagttcccatgcgctgtccggcagtggaagctctggtgaaaggactgcctgtggaccgacatacactgcgcctgcttggagatgcagtagggcgggaattgttcccaagagatagctggagggcatctcgagagctacggatgcagttgattcgggaattgagccagagagctgtggaaggggcggtcaaacaagcaggaggaattttgaatgaaagtgatccacatgatagtcaacggaacaccagtggagctggctgtccgtgaggatgagtgcctgacggacacattacgccagcgccttggactcaccagtgtcaaaaaaggttgtggggttggggagtgcggcgcatgcacggttcttctggacggaaaggcaactaatagctgcatctatttgaccttgtgggcagatggacgagaaattatcacagtagaggggctgcgggcaaaaaacggttgcttgcaccctgtacagcaggcgttcgtggacgaagctgcagtacagtgtggtttttgtactccgggattcattcttaccgcagtggaaatcgtcaattccggaaagaagtatacccgggacgaattgcgtaagttaatctccggtcatctgtgccgctgcaccggttatgaaaatattcttaacgccgttgagcgggtagtcggtgtcaatgcaaagtaaaatggtgggaataattcctaattatatctctgtctacctgtgtaaaatagtgaacaggttgtggtaactagtgacacgccattggggagacatcttggcagagtaagaaaacatcgaaatcacagaaacactttttgcgggccatgcggagcgcatactggcagcgcatgtgccgcaccagtgattgggattccttctggacctgtacactgtattccactgtagcctgagcaccatgagtattatctgctgggaaaacattagcatcactatttatgggatcaaggaggctctgctgtcacccataactggccttatccccaagaattcacttctttcttcccttgctgaaagacgctaggcagatgctataaaatatctagggaccaagtctcttcccggagttatcacgaaagattatgatgagctatcggggaggctggggctaacgcaatggaaatccaacgaaaggaaaaagccatgcgcacttttgaagaaattaaagataccattgagacggggcttgggaagcacccttgtgatttgaaattacagaatgttcgactggtgaatgtatattcatcggagatttataacacagatatctatatcaaaaacggccggattatctccatttcaccagaagcaaatctggaggcccaggaagtagtggagtgttgcggacagttcgcggtgccggggctcatcgatactcacatgcatttcgagtcaactatgctttcaccagaagctctggcttcagtggtggtgcctcaagggactactacactgtgcgcggatcttatggagattgcaaacgttgcaggagcggatggattgaaggctatgctggattctatttcccgcctgccataccggatgcttattgaagtttcctcacgagtacctacagcgccgggcctagagactaacggagcctatatgggggccgaagaggtacgcgctattatggactggcaggaatccatcagtctgggcgagctggatccctctaaaatcctgctggtgaaagacgaatacatcgaaaagattgcggataccttggcgcggagaaaaatcgtaaacggtcatgccatcggtcgcctggggcaggaactcaatgtatatgcttctgctgggatctctgatgaccacgagtgcgttaccgaggaggaacttctccaacgcctacgggtgggtatgagtgtgttggttcgggagggcagcaccgaacgcaatttggatgccctcatcggcggtgtactgagagagaagctgcctctggacaatctgatgttctgtacagatgataagcatgctggagagatccaacgggagggccacattaactataatgttgcccgggccatggaattgggtgtgggagaaatagacgcagtgaagctggctacgctcaacgccgcccggcatttccggctggaagatgagatcggatctattacgccgggccgcctagcggatattcttttggtggaggatctgcgggaaatgaagcctagccaggtgtattttgaggggcgcctggtagcgaaagattgcaagctgatccagacatgtgaagttggggaatatcctgaatggttgaaaaatacagtaaagctgaaacagctgattacggaaaagagctttcgggtccccgctcgaacggatcgtccccagacgcaagttacagttatagatctgattgaccggcagattatcaataaacggctaatcgcaacgttgccctgcgttaatggggaaatactggcagatccggtacatgatattttaaagctggccattgtagagcgctacggaaaaactggcggtgtgggagtgggatttgtacggggctttggcctccgggagggggctatggcctactccatgtcccacgatcaccataatatcgtggtagtaggtgtcaatgagctggatatggcacagagtgttaaggtgattcaggaaatgcagggcggactctgtgtggtccgtaacggcgaggtgatggcaaaaatgcgcttacccatcggcggattgatgagtgagcaggatgctggcacggttatgagggaattggacgggctaaatgctgcggcccgaagtctgggatgccgcgggagtgcccctttcatgactttgagctttatctcgcttcccacagtgccggaacttggattgacggatatggggttggtggatgtactggaacatcgactgatcccggtggaaataccagaaaaataattggggatttctggcggcgagttgaagcaacacatggttccggaggggctctcttggctgcgggcccctccatctgacatctaaaatattccttgataactcggatcataggctccatatttcctgtgctttgaagcctaaaacaaagaaggagaatggcgttactattctccttcttctaatttttgtgatgtatggcgcgaactcttttttggcgtaaaattctcttacttccacagtaaggtccagacttcttgtgagatactcagcattgtctgctttaaaatataccggattactttcgatactttctcaggtatttattttgatggctctggtagcacgctggcctgcagggactgcaaaaggatttgtgactatatgctcaaaaacagtttaggattccttgtattcagcaatatcatccaaattgcaatgaagagcagaacacaacttatccaaagtttttgtttcaatattttcatttgctctaagtctgcggatcgttttgctgtcaatcccgcatttttctctaagctgatacatagaaataccgcggctttccatagtagcccacaggcgatgaaagataatcatttgcttcacctctgtatttatacagtgtggggattataaacttgctttttaaggggatataaccctcatattctgctttagaaattaagaagtacggccctatacacgaaatgaacgtagtgggaactttgattgcccgagctgtgaaatgggggggcgggaagaccacatccgaaaaattctgggaatcaatatcacatgtaggaaaccctgtatgttcgatcaggatctcatatagcggtcttttaatatttttaccagagggacctgttcggaaggcgtaaagatacgactcaccacccgcccgattggatattaccccgcctccagtgcgtatcgtgacttgaaggactcattcaggtatctggcggggagtatttcatcaatggtatcctggcggatttagaaaaagaaccaagggaagcggacgtgcaggagtgcagaaggagccaaaaccatgccttatctcaaaaccggttccggggaaaatttgataaggagtgaaccataggaaatgcgctgtcagaaattatttgaaaagggatgtatcggtggagtagagatccgcaaccgtgtcgcaatgacggctatgggaaacggattggcgtcctgggacggcgaggtatcgctggaactgatccgattctatgaggatcgagcaagaggcggttgcggcctgattttcacggaatttactcggatggatgaaaccagcggcgcctgcaatccaaatcagctctgtatcgccacccgtaaacatatacgtagtacggagcgggtccgctgtcacggcgctaggatatttgttcagctctaccacggcggccgagagaccctgtctgtgctgaatgacgggaaacagcctatggctcctagcgccatcctcaactcggcatggcgcagttgaggggcaatgatatctgcgtcatcgacagcggcagcggcagggagacggggcggaaggcgcggcggatcttggacgccaacagatggcgcctgtccaactaccggagggctttgaggtgatcgccctctcagtttccttaaaggtgcaagattctatcccaattgactatggcagtggactgacagagcgttgagggcacattgtagtcaccaggtcgcatcgaaagacgcggtccggtgacttgtagcatatacagaaggctaccactccaatgtaatgcctttattggggtcaagctttgcaattttgaaacctgctaaaatgcaaatcagcgtaaagataggagtcatccagttctggaatgcatacgaatttgtgattatatcaactacgaggacgatctttgggtatgttgttcttcattctgtactgaagactttcggtgtgggagtagatataaaattattttatcagagtattctggataaggacataactagtacgcaggagacttattacgacggggcacaggcattgtatgacctgcgggtccttttgatctgcgcggtccacggatattgtctgggcggcttgtgctatcctgccggggcagatatttctatcgcagtgaaaggtggagaagttatcaatagctctgccaatagaaggcgccggatgatcaaaggagcttaggcccggctgatttcggcggctttctttttctcggagttcccgtcattttgcggtgtcaacctggctcaagaataaaggtgcttcgagacggaaacacggacatatccgctctgatttcaaagataatgcggagtggagcaaaggattgaagacttggggccgtcataacaaggtagcgcctacagttcaaggctgtccggatgggaatggatcatctgccatgaggagtgagcacatgaattgagagatcatgaaaaatcaaatgcttatattaaacaaaaattcaaggggaaaattgttgatattgcgatcttccttgacggcaaaaaaacacgtaaactattggtgttggagttcccaacaaaattgaaaagcctgcatatgctctccatctctcagctgtgcgggtgccaaaaaggaggaaatacataccggtacggctcacggtgcggcagtgtggagacctgttgtaaagcgcggcgcccatcgcggtaccgcgtgagaacgcatccgcggaggcggagcggtcagagccgggaaagatggcaggactgtctttggtaaatgtgaagaagatctatcccgcaacgaacgatcacaagaagtccaaaaagaagcacgagagcggcgaggagaaaaaggcccagctccaggtgaccaatgagggggttgtggctgttcaggaatttaacttggatgtggcggacaaggagttcatcgtgttggtcggcccctctggttgcggcaagtcgaccactctgcgaatggtggcggggctggaggagatctccagcggagaactgtacattgatgggaagttgatgaacgatgtagcccctaaagaccgggacatcgctatggtgttccagaactacgcgctctatccccatatgacagtgtatgaaaatatggcgttcccactgaagctgcgcaagcgccctaagagcgagattgacaaagctgtgcgtgaggcggcggagatcctagacattacgcagtacttggaccgcaagccaaaagctttatccggtgggcagcggcagcgtgtggcgattggccgcgctatcgtacgggaacccaagatcctgctgatggacgagcctctcagcaacttggacgccaagctgcgtaatcagatgcgcgcagagattatcaaactgcgccagaagatcaatactaccttcctctatgtcacccatgatcaaacagaggctatgactctgggggaccggatcgttatcatgaaggatggcttcatccaacagatcggtacgcctcaggaggttttcgaccatcctgccaatctgttcgtggctggcttcatcggtacgccgcagatgaatttctttgatgcggagttggttggaaggggcggccattatgctgtcgttttggatggcatgactgtagagctgtccgagaacaagcaacaacgtttggctgctaagggcgtggcggggcagcatgtcacactaggcgttcgtccgcagcatatctccctgcagtgtgagtccggctctgtcaaggcccggatggatgtatttgagatgatgggcagtgagatccacctgcacgccaatgtgaacggtcgagatatggtcatcattgtccctaccacagatattaacggcaactattccgatgctttcaccattggtaaggagattgacttctcattcagcggcagtacgtgtcacctgttcggcaacgacggcaagaacttggaattctgagtctttctcaatctaaagaatctgaagccgggctctcacgaaagggagaacccggctttctcttttgggaagagttgtattccatacgcctctggtctcgccgcctccaaagcagtggcggaaaaatggagacagtacaggctggagtggtgtgtctgtgccgtgagagtgtccggcctttcactggaccggtggtcagataggtgttgacctgctcttggaacacatagcgaacaccttgtgaggatagcggtcataatggctacaatgagtctgcttgcaaagaacatcgggattggggcaatcactagggttcgaagataacaagcagagctgaagctggtggacagggacagacaatttggagaaataccttgctgcttatctgaaaagaaacccagtgtggatttctttgctcggggctttctgcgcccaagcttgctgcgggcatttggagagggcgtctttgtcggcaatgaccgtaacatcctgatggagctggagaatggaagctggtattccgggagtcaccggtccaaaacagctggcgtaaatggcgtcggccttatcggcaccgctggcgatcagaaggatctttctggcttgggtaatggcttgcatccccatggagatggcttgccggggaacgtcctcctcccgctcgaagaagcgggtgttcgcggcgatggtgctttccgtcaggtcaacctggtgagtgtatttggagaagtgatcgtccggttcgttgaaaccgatatgggcattacggccaatccccagaagctgcaggtcgataccgcccaaatccgcaatcagacggtcgtaccggcggcactccgcatccggatccgcagccatgccatcgggaatatggatatggtcgggagcaatattgatgtagtcgaagaagttcttatgcatgaagtagtgatagctctgcgtattgtttgccgacagcccccggtactcgtccagattcaccgaggttgcctccgcaaagtccagatctcctttttcgtaccagagaatcaactggcggtagacccccagcggtgaggaacccgtagccaggcccagcacactctccggcttcagaataacttgggcggagatgatgttggcggccttgcgactcaagtcactgtagtctttcgcacaaataatcttcaatgaaatccctcctgtcgtatgtcacagactatttccggcagctgctatgttgccgatgcagctatgccgatgtgctcctccaatgcgaagtatccccgattcactagaatcagcaccctagcaccggattgtacctgagatgaactgggatacgcccgttctacacgggatcggaaatgcttgagaatgacagcctccgctcgaaacaggccgtcagaataagactcgatgttggatcttcgtatacagggggattctgttatattcttccttcggcagtgtccaaatagtatcagccagcagttccgaagtgacactctccctggccgcataaaagatacgtcatctatttccttgtgaagatagcggctgccaagggtgcaacagcgattctcttcctgcatggtaaagaggtgggaatgtcaccttgctcaaaaaacgaatgaatagaaataggggtgcggcctacgccattttggcatagacttgcgggcttcagcgttttggagaaggtcaaccgtcggcctttattgatcaattgaccagaggcccgaatagccgaaccgtaagtcgggcccacaggtagcccgctgctgctggccacaagaaagaccacacgaaaatcagcagccagaaccaccggggagagaagaacagcactacagcagggatgaccagcactgccaaaattgccagagaccggggcagccgcccaatgccttggactagggccgccttccacagctgcaggaagcgaagggagggattggcgttgattaccggcggcaggaaggccaaggccatcagcaggcagaacaccagaaacagcacgcctccccagaagaagagttggacagaagggggcagactgccgatggcctggaagtccagatagaacagatacgccaaagccaggatggccacccaacatttcgtggcgggcttgaagagctgccggaagtgggaaaagtacccccggatatgcatcggggcaccggccaccatgtctaccatggagctatatagcgcgcaccaggaggccccggcggtgaccactggcagggagcagagcagagtgaggatgctgaggacgaagaagtccagcagggtggacagggcggacatcacaggggagtccagatcaaacaggtggcgcacaggcgttttctcctttctgtagggcttccagctggcgcttgtagatcagcaggaaaacgatgtggatgaccaaggttagcgtccaggagacgggataggaccagtacaggctctcgatggtccccacagctttgaagatggtatacagccagatgacccgcagtccacaggcaccgatcagtgtggtgacggtggggttgatggttttgcccaagccgcggatggagccgcaggcggtttccatcatgccgcctatccactggaactgactgatagccaggacccgggtcacaccggcggccatcacggcctcataggcgtcatccgcgggcttgacgtagatgcccagcagctggggctggaagagccgcagcagcacgcacatcaccagacccaggcccaccgtcagtcccatgcagatccaaaagacctggaccgcctgccgaggccgtttggcccccaggctctggctggtgaaggtgatagtagcctgatagaaggtgttctgggcggtgtggataaagttctccagcccggaggcggcggagttccctgcgatgacggcggagccgaaagagtttacggcagactggatcatcacgttggcgatggagaagatgatgccctggatgccggcggagaggccgatcttcaacatgagcgcggctttgtcggggtagaggcggatcttccgcaggtccagacggcatatggaattgatcgtgcacagccggatgatcaccagaacggcggagagcagctgagagacggaggtggcgatagccacacctgccacacccagatgaaagacaataacgaatagcaggttcagtcccacgttcatcgcaccggaaacgatcatgaagattaggggatacaatgtgtcccccactgcccgcaggatggcactgccgaagttataggctaccagggcggggatgccaagaaagtagatcttcaaataaagagaggagagcggcagcacatccattggagccccggccagctccagcagcggtgtggagaaaagaatccccacgacaccggccatcagccccaggatcacgctgaggacggcggagcagtggaccgtctgggagatggcctcctgatccccggcaccgtagtaccgggcggtgagatagttggtgccgatggatacgccgttgaacagcgtcaccagcaaaaagataatagaggtagtggcccctactgctgccagagaagtgctgccggcatagcggcctaccactacggaatccgccgtgttataggccagctgcaagaggccggtgagcatcagggggattgaaaagcgtaagatggggcggaaaagcggtgactgatccggctgactgtatgtgatttgtttcaaaatgtttcctccctttgggagaagtcccctcagaattgatttatcatctgcaagtattgcagaaagaaaaataaatgtcaagagagaggctgatcttgaaaaaaagcacggaaaactgcacagataaaatttgcgtaaaattttcgataacagtggactgcttttttgaggaaatcggttgaacatggaataaaccaaaaatgtttcagaaatatatttcggaaacggagataaaaaactgggagattcgtaatattgacaggcttttgaggaaaagttataatctttttacaggaaaaaaacagataaaaaacaaaaccaatcacaggatagtactagcaaaaaaatttgtttcagaaataaaatgtgaggaagggctctatgaagatcaccgtccggaaaatcgcggaggaagccggtgtgtcaccggcctccgtctctcgctatattaacggatctgaggacgtcagctctgagattgccagcaaggtggagagcgccctgttctccttgggcggaagtccggtggtccggcggccccgcaagcagatcatcctgatcctgctaacccatctgcggtttgacttctacgggcgcaccttggcggagctgctggagcaggagccgcagagcgaatacaccttcatgctgctgcgctataacccccagtcgccggagacagtgcggaacttcgtgagccggatgcatcccgttggcgtgatctactttgaggaggagatcgacagcggcatcctgcagtatctccaaagctgcggcctgcggacggtgatgtgcggcggcgtggccctggaccaccagtccgaccgagtccatgtaaatgacatcgccgccgcctatgagggtaccaattacctgctggatctgggccaccgggagattctcttcctctcggacgacgagcagaagatcggcgctgggttccagcggatcaccggcagccgcaaggcgatggaggagcggggactggaattcccggagtccctggtactccggggcggcgtcaccttcgaggccggctaccaagccatggccacagccctgcgggagaaaaagcaattcaccgcggcattcgccttcagcgatgagctggcggtgggcgtcatggcggccctgtacgacgcggggctgcgggtgcctgaggatatatcggtcctgggctatgacgacctgaccatcgcaacccggatccgtccggcgctgaccaccatccatcaacccatcgatgtgttcatcgagaaatctctagagttgttccgccagccgccgaagtcgatccactcggagattctgctgcctcactccattgtggagcggcagagctgccgccggctcagcgatccggtgccaaaatctgtttgatccctcggaatggggtgtttaaggaaacgaatcaacaaaaggagaatcggtatgaaaaagaagattacagcattgctcctggcactgacgctgctcctttccgcaacagctctcaccggttgcggcggcagcggcgaaagctccgacggtcccgtcagcctgaccctgtccctgtgggatgaggcccagctgccggtgatccaggaaaatgtggacgcttttaacgctgctcacgagggagagatcaaagtcaacatcgagcagatcccctgggacacctactggaccaagctggatgcctctctggagaccaatgaggccccggatgtgttctggatgaacacctacgtccagaaatatgtggacgccggggttctggagcctctggacagctacattgagggcgagagctttgatatgagcgtctatgccgaagggcgtgtgaacgcctacaatgtgaacggccagcagtacgccctgcccaaggggctggatgctgtggcggtggccctgaacaccgagctgtttgaccgctacggtgtggagctgccccaggagggctggacctgggatgacatgcgggacatcgccacccagctgcgggacgccatcgcggccgccggaggcagcgagtaccccatcgtcatggagctggacgcccagccgtcctggatgaacttcctgtatcagaacggcggcaactacctcagcgatgacggcaagacatgcggcatcgccctgccggagtccaaggacgccatccaacaggtagtggacctgatgaacgatgagcagatggctccctactccgtgctgacggagaccaagggcaccgacctcttcatctccggccaggcggccatcgtcttcatcggctcctggaagtccggcgtgctggaggacagctctctggcggcagacggcaatgtccagctgatccagatgccctccatggctgtggacaacaagaccaacatgggcggtctgggctatgttatgtctgccaactgcgagaacaaggaagccgcctgggagttgatgaagtacatcaccggcgaagaggccatgagccacgaggcggaagagggcatcgacatcccggcgtacctgtccgcacaggaggggtatgtggccaactttaaaaatatcaacgcgcaggtatttatggacgcatccgccaacggctttgcctatccctccaacggcaattttgactggaccaccatcgtggatgacgccatgcaggaggcattcggtcaggtgaagactgtggacgaggctatggatgagggggttgcggaggcacaggccattctggacgaggtctttggctgagcccggcagagacagagacgacccggcgaaaacgtgaccttccgtcttgcggcggccccctccggggccgccgcggacagggggagtccgtgggcccaaaagcgcgctccgattcagaacgcggttttgcgcccagggcctcccgagagacgatacggggaaacaggaggaacgcccatgaaaaatcaggcacggcatttcggcaggctcagacgcgcggagatgtgcactgcgtacatcttcatcctgcccatgtttgcgggactgctgctgttcagtatcattcccttcattcagaatatcctctacagctttcggaagatggggaccttcggggagggaccttcatcggcctgaagaactatcaggacctgctgaaggacgacaccttctggctggcgctgcagaacacggtgttctatgccgtggtgggcgtgccgctggtcatcatcttctccatctttctggcccatcagatcaacaagaagatccggggccgcacgatctaccggactctgctgtttatcccggcaattaccatcccggcagcgatcggtatcttgtggcggtggattctcaactatcagtacggcatcttcaactggatcttggagaagctgggcttttcccggatctcttggctgggtgatgtaaaatatgttcgatgggcaatcatcctggtggtggtctggtccatggtcagctactatgttatcatcatgctggcagctatgcagggcattgacagctcctattatgaggctgcccgtctggacggcgccagcagccgtcaggtgttttttaagatcactctgcccatgctgacccccatgatctttttctccgtcatcatggtgacgatcggcattctgcagatcttcgatttcatctacctgatggtggaccggcagacgctgtcgtacacctacagcatgagtctggtgacgtacttctacgagtgcgccttcaataagagcagcatgcggggatacgggcggccatctccgtggtgctggctgccatcatcatggtgatcaccatgatccagatggtcggcaagaagtactgggtcagatctggcgagtgagcgggggaggcagccatatgaaacagaaaagagaccgcctgaacgacgagagcaggctttcgcgcttcaccactcatgtggtgctgatctttgcgtcgttcctggcctttggccccttcgtctggatgtttctcacatccatcaagacgtacgaggagaccattcagatccccatgaagttcctgccggagattccccaatgggtgaatttcagcatcgtctccgataagctgaattttccccagctgtatctgaacaccattctggtgacgatcatgatgatcgtgggccagatcctgatcgtcacgatctgcgcctatgcctttgaccggctgaatttcccgggcaagaacgtcctctttatggggatgctggcactgatgatggtgcccggtcagatcttcatcatcccccgcttcaagctgatggtgaatctgggcctgaccaacaccctggtgggcctggtgctgccgggactgttcaatatcttcggcgtgttcctgatgcggcagtttttctccactttgccgcgggagctggacgaggcggcccgcatcgacgggtgcagctacttccggacctactggaatgtgctgctgcccctggtgaagccggggctgaccacgctggccatcctgggcatgctgaacacctggaaggacctgatgtggcccctgatcaacaactcccaggcggacaagatgacgctggcagcgggccttgccatgctgatcggcgaacatacgacgtattatgagcaggtcatggccggcggcgtcatcgctgtgctgcctctgatcgtactgtttgtgattttccagcggcagtttgtacagggcattgcccacagcggcatcaaaggctgagacaaactgcgaaaaaagaaagggaagtgagcgtatgttttaccggtacccgatcaatgatgtccacatccacctgttcgaccccaaggacatcgacgagtgcatcgccatggtggatgagtgcggatataccaactggacgttcctggcctgtacggtcatcgacagtcccttcgctctggcccagaatctgctgtgcgccctgatgaagctgaaggagggcggccgctgccaggcgttcggttccttccactacaatggggacgtggtgccggacgcggatgacctgttgcggcagatccagtggttcgaccaagcgggcttcgacggtatcaagatgctggatggcaagcccggcgtgcgccgtcggcaaaatctgcggctggacgcccccaactacgacaaaatgttcgactacgcccagcggacccaattccctatcctgtatcacatcaacgaccccatcgagttctggtatcgggatcggctgccccagtgggcggtggagaagaacttcttctacggcgacggaactttcccccacaagttcgagatcgatgaggagactttcggcttcctgcgcaagcatccgaatctgaacctgtgcatcccgcacttcttcttcatctccgaccagccgggcctgtgctgcgagatgctggaccgctatcccaacctgttctttgacatcactccgggatgggagatgtttgagaactttgccaaggaccgggagtactggcgcagcttcttctcggagtactcccacaagatcctcttcggcacggacaccttctccgaccactggagggagaccgtcacctgcctgcgccgggtgatggagactgacgagcccttcgttgcctttgaggagaactgcgtgggcctggacctgccggagaagaccctgcgggacatctatttcaacaactaccacaagttcatccgccggatggacaagaagatcaacgtggacatggtgctggaatatgccgacaccctgtatgaccgcatccccgcgggagagaaccgccagatgatctccgacaccatcgactatctgaaggcggagatcggcaaattccggtaacggcagaagagaggactattcgtgaaactgtgtgtgatcggcggggccggtgcccgctccgcgtttttgaccaaatctctcgtgaagagcacccgggacatccgggtggaccacattgtcctgcttgacaacgaccagcagaagctgaagacttacggggagatctcccgggagctgtcccgtcggctggacccggacctgacctttgaggtcacctccgacgcccgggccgccctgacgggagtggactacatcatcaccaccatccgggccggcggggacgccgggcggctgtttgatgagcagacctgcctggcccacggcgtactgggacaggagaccacgggtgccggaggcttcgccatggccatccggtccgtgcccaccctggtgtactactgcaccctggcccgggaggtggccaaccccggccatctgattttcaactttaccaatcccagcgggatcatcacccaagccctgcggtccaaagggttcgacaacgtgtacggaatctgcgacgcccccagcggcttcatcaagcagctggaggagattctggagatcccctacggcacgctggatatcgagtgctacggcctgaaccacctgtcctggttccgcaatgccaaagtcaacggccgggacgtgcagcgggagctgctggacaatccccggacctatgagcattcggagatgcggctctttacccgggagatggcccggatcagcggagactgcatgctcaacgagtatctgtacttctactaccggcgggtgaagtctctgtccatgatccagaaggcggatcatccccggggagagatgatctacctcatcaaccgcgagctggaggaacagctggcccgactggagctgccccgggatttcgagcaggcgttcagcctgtatatgaccgcctacggcaagcgggaaaacgcctatttctctgtggagagcggagcctgccgggaaaaggtgtggaatccgcccacggtggaggagttcctcaccgccccggatgagggcggctacgcagcggtggccttgcggttcatccgggccatcaccgatggggagaactgccggatggtgctgtccgttccaaacaacggggccatcgacggtctgcgggacgacgatgtggtggagatcacctgcgatatccgctccgacggcgcccatcccgtccgcattggtgccatcgacgagtttcagcttcagcagatcaagcggctgaagtactttgagcggtgcaccatccaggccatcttggaagatgaccgggatgcggccgtcaaaggcctggccctgcatccgctggtgaacgacttcgagctggcggagacgttgacggatatcttctttgacaaatacgcggaatttatccacatgaacgagacgccttaaagacggatcggagagagtgtatgtacgatttcaagacctttgcacaaatgaatctggacttgatcttccaaggctttgaccggatgccccagcccggggaggaggcctttgcaaagcgattcaccatgcagttggggggaggccccatcgtctgccccatcgtgctggagcaactgggcttccgggtccggctggggacgtttctggggcaggacgatgtgagcaacctgtgccgccgcctgctggaccagcggggcttctccagctacgacgagttcgcccaggacaacccggacccggtggtagtgaccagcgtgttctcttgggaacacgaccggggatttctggcccacaatgagggcgtctatgagagcattttggatccggagaccgtctatggcttcctgcgggacgccaaggtggtgtttgccccggtggggcagccggaggtgacccgccgccttcatgaggagggagtgaaggtagtctacgacagcggctggagcgatgacctgtccattgacggcatcaaggcgttcctgccctatatcgatgtctacacacccaatgacaaggaggcacggaagctggccggcacagatgacctggaggaagctgtccgctttctggcgggctacacgcctcacccggtggtgacgctgggcaagggtggctgcgcatactggcacgacggttccatccgctatgtatcggccatcgatgaattccgggcggtggatactaccggcgccggagacaacttcctcaccggcatcatttacggcttgctgacggaggagcccctggaccgctgtgtgcggctggggaacatcttcgcgggtaagtccaccacggcggtgggctgctttggcgcggcggtgacgccggcactaatccgaaaatatctgtgagggcgggggaggatacggctgtgcgcattcagccggaccgcctggaggagacctttgcgacccaggtggacgacgacagcccctcctacggggaacggcagatggctgaccagccgcctctgcgccctgggcctgatggtggaagaggacgacgcggcggagattttgggccgggcctcctatgcgggcttttcaccggaggcgggcgccagcgccattgcagccaccaatatcgtcctggaccggggccagatccgagaggagattcgcagcggctcccaccagcggtacttccgggcctgccgggccagggggtatgagacctggacggtcaccaccttcggcggtagcgataacagattgccggtagccaatggtatcacgggcatcgtgatgccctccgccatgcactgtcgccgctcctgtcaggggatacacttctgttcaggagatggtcgcagtgacagaaatcacggcggatctggtattgaaccgggactgaagcaaaccggctttccgcaattttgagaggagggagagacatggcactgaagctgattatcgtttctgatttcgtctgtccctactgttactggctggagacacttctggaccggctgggggaacagctggagattatccatgtgccctaccaattgacagaaccgccagcgccccggatagacgtatggaacgatcccgtccgacgagtacgatacgctgagaccctggggcccgtctgtcaggctcaggggtagagatgtgtctgccgccccgggtgattccccggccatacacggacctggctttccagggctggtgctttgctggggaacgggacagaggagagtccttctataaagcggtgtttcaagcctattttgtagatgagcgggatattggagatttgtctgtgctgacggaactggcagagaactgcggtctgtcagggcaggacttccgcgcagccttggtggcagggacttatacagagaccgtccgccggcaatcccgcctgtcccgggatttgctgggtattcacatggtgcctaccattttatcaggaaaaaaacgactggaaggctttgttccgaacttgatagagctgaaggcatggttggatgcggtgcgttgagatgcctgaacgtaagcatcaaatacaaaaaacaggtagacaggtatgagaaaatagtggaggaaaagtcacaggcgaaggggagggggacaagaaggtaaagtgaggatctatcttctgtgtttcaatatccactgtaaattattaaaagcggcgttccattcgatggaacgccggcccatcattctcttccttaaacacctgaatcagttatgaacaaacacccgtataaactcgttgagcgtagtccgttgttcctcttcatacggtttagtgcgggatcctgcaaattgtcttcataacgatatacagtttctttgctcacgtcgagccgttttgccaaagatgcacgcgacatcccgcgatctttccgaagacgacgtaaccttaatccaaaatcaaaaactccatctgccgacatacggtcaccctgtatgcattgtaatcctccagcatagttgttatatgatgtgaagatatgtaaatattagtcaaattaggttgacatttaccggatattataatacaatgctaacaaaaatatatgaacgccagcacctgtacaggctgctcacttaatcactatgcgtatcttcaaatgaaaattcttccagttctggatagtcaaaaaattcagataacgtaagactgaatgcagatgcgatcttgtgaagcgtctttatttttggattgaatgtcttgtgatttatgagattatcaagtgttgagtagctgataccactcatggcagacaactgatatattgtgaagtcacgttgcctacatagctccaaaatccgtttgacaataatttgtgaatattcgtccttcatctctctacctgctatcaatgagtaataccttaaatggtgttttctctatgatagcaataaaaatagcgcgctattcccgtgcacgggaatagcgcgtgatggaatgaacggtatgaattatgttgcttgaatagaaaatagaatgtgttgcatcactcaagagaccaaggattataatagatttgagattgaaaagagtgggggaaacagctatgaaagaaattcgcatactcattggcggaatgggaaatgctgccaggccgatggtcgatcttctgactagcgaacgggagaggatggagaatgtatacgggctccattttcgaattgttggcgcagtggacagtagaggtggagtgattgcaccgaatggaatttccagtgtgacgttatcggaagccaaaaacaggggaactttggcagatatccccggcttgggtattcagggccttacggcattggagatgatcgagcagtgcagcgcggatgtctatttagatggattgccgccatatctgcccactggggagccggggacttctaacatccgaagggctttggaacggggaatgcatgtggtgaccgcaaataaagcgccgcttgcccttcattggaaagaactgttttccttggcggcacaacaggggctccaaattcgctatggaacagcggccagcgcaggactgcctactctggagatgggtaaactgttgggacgttgtggagagctgctggagttcggcgggattttcaacgcgtcttgtatgtacgtttttgatgcgatggggcagggacagtcctttgatatggctgtgcagggggcgaaggcaggcggatttttggagccagatccctccatggatctcgatggatgggatacggccatgaaaacagttatccaggccaatacctattgggaccaggcatatacgcttgcggatgtggcgatccaaggtatctgcggcctgacacaggcagatatgatagacgcgaagtccaggggcgaggtttggtgcatggttggccgggctgtccagaatccggatggcagcctgaaactgactgccggaccggaacggcttccggcagatcatccgctggccagggcacactggagcgataaggtgctttggatgcagaccagaacgcagggagggcaggtgcaccactgcatcggtgcgtcggcttccagcacacccggaaatatgtatttagacttggtgactattgccagggaactttaatgaataccttttcagaaatgcagaaataggtgggggggctttgttcctgtttagaatcggcgctgccgttcttgaatttttttggggaggaaaagaagtatgaagagagtctttgcgctggtcctgacattggctacagctttagggttggccgcctgcaacagtggaggaggtgaatccggggaaaatgtggtgaggattggaatttttgagccggccactggcgacaatggcgccggcggcaagcaggagatgctgggcatgcagtatgccaataaggagacccccactgtggatatcggcggcaccacctataccgtggagctggtttatgcggacaacggctccgaccccgccaaggcgcccactgccgctgcggagttggtgagcaaggatgtatctgtggtattgggttcctacggctccaccgtgtctctggctggcggccccgtctttggcgaggcgggtgtccccgccattggcgtcggatgcaccaatccccagattacggcagggaacgggtattacttccggatctgcttcctggatccgttccagggaacggtgttggcaaatttcgcacaggagaaattctctgcgaaaaaagcttactgcctgggtgagctgggcaacgagtacgaccagggcctgattaattattttgagcaggcatttgacggcaccgtggaaaaggattccttcccgaccaatacatccgacttcaccacatatcttaataaggccgtaaatgaggacgcagatgtgattttctgcccggtttccattacatattctactcagatcgtgaagttggctgcttctctgggaattgaaatccccatcctcggtggcgataccctggacagcaatatggtgctggaagcggccgcaggcagcgacgtgcagctgtacgtgtccaccttctaccaggagggtggctctccagagtttgacgagggctttaaggcctggctgagcgaggattccaccgccatgaccaacaacggcggcaacgataccatcgccgctgtcactgccatgggctatgacgcctactatgtggcgctggaggccctgaaggccgccggctctaccgacaaggccgccgtgaaggccgcgctgcctgacgtgacctacaccggcgtgtccggctccatcgcctttgacgagcagggcgacgccatccgggacaccgcctatatcaagaccgcagacaccgccaacaacgcctggacgctggagacggtccagactgtggaataagcctgccatccggccagcctggcggggtatcccccgccaggcggcttgttcttgcgcgagatgggaccgcctcgaaaggggccgcagcccggcccttttggagacggtccttcccgctcgccaactctgaaagaaaagggggtatccctgtgcaatacggaatttccatcctgctctccggcatctcgctgggcgggcagtacgccctgatcgccatcggatacaccatggtttacggcatcctgcgcctgatcaacttcgcccacggcgacgtgttcatggcggcgggattgatcatggtctatctcagcgcaagcctgcccatcggcgtggcgctgccgctgatgatcctgctgacggtgctgctgggctatgtcatcgaacgggcagcctacaagccgctgcgcagcgcgccccggatgagcgtcatgatctccgccatcggcgtcagctatctgctgcagaatctggccacctatatcaccggcggactgccgcagatgtaccccagcctgcccggcctgtccagtcagatcaccattgccggcacctccaccaaaatggtgacggtgattacgccattcctggtggtggcgctggtagtggtgctgacccagctcatcaaccacaccaagatcggcatggccatgcgggccgcctcccgggattttgagaccgcgcagctgatgggcatcaagatcaacaacatcatcagcttcacctttgtcatcggttccttcctggcggcggtggggtctgcgctgtacttcaccaactatccctccatcgtgccgctgtccggctccctgccgggcctgcgggccttcgtggcggcagtgttcggcggcatcggctccattcccggggccgtggtgggggcattcctcatcggtctcagcgagacggtgatcaagagctccaactggagtgtgttttccgacgcgttcaccttcgcgctgctcatcatcatcctggtggtgaagcccaccggcctgttcggtgagaagtccaccgacaaagtgtaaagggggcgtcacgatgctgcaagaaaaaaagagcaaacggggcgcgtggatcgccctgggctgcgtggcggccctgctggtcctggtgattgtgctggagaacaccatgcagcccaccagtatgctgttcaccgtgctgaagaagggagctgtgtacgcgctggtggcggcctccctgaacctgctgaacggctttacgggcctgttctccctggggcaggcgggcttcatgctgctgggcgcctacacctacgccattctgaccattccctctgccgaccgggagagcgtctactacctctacggcggctcggcagtgaatttctccctgccggagctgttcggcggcggcgccctgggtctgatcctgggtgtgctggcggcgctgatcctggcgggctgtgtggcggcggtgatcgcctggcttatcggcctgccggtgctgcggctgaagagcgactacctggccatcgccaccctgggctttgcggagatcatccgggccatcttccagtgggaccggctgggccctgtcaccaacggcgccaacgcgctgaagagctttcccaccttctccagcttcaacatcgagaacgccaatggggaggtggtgctgcgcctttccacctttgtgcccttcctgctggtggcagtgtgcatcgggatcatggtgttgttgatcaactccacctatggccgggccttcaaggccatccgggaggatgaggtggccgccgaggccatgggcatcaacctggccaagcacaagcggatggccttctgcatcagctccttcttcgccggcgtgggcggcggcctgttcgccatgttcgccaaccaggcccaagccaagaccttcaccacctccatgacctacgagatcctgctgatcgtggtgatcggcggcatcgggtccatctccggcagctgcatcgcctcgttcctgtacgtggcggccagcgagtggtggctgcgattcctggacacagagacgtatatcggcgccttcaaggtgcccttcctgcggaccggcttccggatggtggtgttctccatcatcatcatgatcgtggtgctgttcttccgccgtggcctcatgggggaccgggagctctctgatgtggcccggagcctgcgggcccgcctctccggaaaatcgaaaaagaaggaggcggcgaaatgagtgagaagatccttcgtttggagaatatcaccatgcagttcggcggcgtcatcgccgtgaacaacatgaatctggaggtaggcgagggggagatcgtctccctgatcggccccaacggcgcgggcaagactacggccttcaacgtcatcaccggcgtgtaccagcccaccaacggcgcggtgtggtaccggggggagaagatcgtggaaaactacccccagggcaagatgcgcaagctctacaagggcgagcacgccggggagtacacccacgccctggcccccaccccggacaagatcacccggatgggcatggcccggaccttccagaatatccgtctttggaaggaccagacggtgttcgacaacgtgctgacggccatgcactgccgtgcgacgtgcaacctcctcactgcgaccttccatctgaaccggcaggaggaggcgcggcagcgccagcgggtggaagagctgctggcggaggtgaacctcagcgacgtttccggggagaaggcgaactccctgccctacggcaagcagcggcggctggagatcgcccgggccctggccacggatccgcagctgctgctgctggacgaaccggctgcgggcatgaacccccaggagaccgacgagctgacggccttcatcggggagatccgcacgaagttcggcctgacggtgtttctgatcgagcaccacatggacctggtcatggacatctccgaccggatctatgtgctggacttcggcaagctgattgccgacggcacaccggcggagatccagaacaatcagcgcgtcatcgacgcgtacctgggggtggcggaagatgcttaaaatccaacagctgcgggtgtcctacggcggcatccaggctctccggggcatcgacctggaggtgccggacggcaagatcgtcaccctgatcggcgccaacggcgcgggcaagtccaccaccctgcggaccatctccggcctggtgaaggcggagtccggctccatccagtggaacggggaggagctgctgggcaagcccatcgacaagatcatctccgcgggcatcgccatgagcccggaggggcggcgggtgtttgcggacctgacggtgctggagaacctgaagctgggagcctacctccgcaaggacaaagcggagatcgaaaaggacctgaaatgggtctatgagctgttcccccggctggaggaacggaactggcagtccgccggcaccctctccggcggcgaacagcagatgctggcggtgggccgggccctgatgtcacggccgaagctgatgatgctggatgagccgtccctgggcctggcgccgctggtggtgcaggacatcttctccatcatccgggagatcaaccgccagggcgtgacggtactgctgatcgagcagaacgccaacatggccttgaagatcgcggacctggcctatgtgctggagacggggaacatcaccatgtccggcaccggcgcggagctgctggccaatgagaagatcaaagaggcgtatctcggcaagcacagataaggggatagttgtcagatggcaacgggtgctagcggatgtgatgtgtatgcaatttttctgaattggacaagtaaatccggacagcaaagagccgaggcggagagttttcttcgccttggctctttactgcaaggtgtcatcagtcctgtggctatctgttagtaagacatacaaaaggtttttgggcttgcaggctgcaagcccatccgattcaggatgagggatttgaagcagtgacgctgcgaaagatcgccgacgtgacagcatccttttgtttcctatgtgggtggccgtaaagtatggagacttacatttctatttgatgttactaagatttaatttagaaatataattgccgggtaaagcacgccagccaggcgtgctttattcgttttcaggcctatgttgaaggtatctctggatcttcaagaatttagatgatatcagcagcaccgactttgcttgcatcgcattgaaagccactcttcccggtctggtgcgcgcctctgtatttgcacaagaaagacagtaagcgtcacagcaatgagaacccaggggaccattggcatatagagggaaccatgctctgcctgtttcgcatactgactaaatatttatagagtcaatatcgcaggttctgcatttttcacttatttcagaaagcagaagaatctgtccgattgcgtgagctagaagcccacccaatgcaggccaatattatagaaccggcaagagatatggatttacgcctgcgtaccatcaatagtatacacaacaggattcctatcaggcgcttcacacccagctgggggcccgctctttctaatgaatacaccgaaccgctctccggtcttgccttgctcccgatacagcagaagcgctcgttctatcatctcaaagacctgctccttggtgtagatttcatcaatcacggtaccaaggcgctgacgcttaccccaaataccaccgaccataattttatatcctgcttttgcttctgtcacacaatcaaaattacaggcatccacacacttaccgcagttgttgcaggtatcccaatcgatttgcatgatgccatcctcgtccagatgggcatttttcatggggcagacctctacgacggagcacttcttgcagccattgcagtcatcgggattataggcaggtacccgctggcccataatgccgaaatcattcaaacctggcttaatacagttgtttgggcagccgccgatgccgattttgaacttgtggggaagtttgacatcataccagcccttgtagaatgtttcgtgcagttcacgcgctagttcttgagtgtcgatcaggccatggatacacacagtgcctttgcaggccacgatgggacggacgcgggaacccgtgccgccagtataaagaccggcttgggcgatgaatgtattgaatggttcgatgttgtcgtaggtcagaccttgaacttccagagtcagacgagtcgtgagggcaattttcccattaccgaatttttgagcagcttcctttttccggtagaacacaccaacagaagcttctcaatgcccagggagctgttaatggatcaaatgcgtacagcgggactcggggaacggcttcgtcttttgaatagaatctttgcaaccaaggaatatgaggcttttgccgctgtggcagaagcaatgggttgccctagccattcgcatgaagcggcttcatctgctggacagagatgacttgaaggacccgtatgcgctcgttcgtatcgattgtgatgaagaatgaatatttgagcaaggaggatattggaagatgccgcgatacaatatccgggaggataatcccgtcaaatacactcaggtaaaggcggagcaggaaagacttcgggcaggcgtttcccgatgataaccagctgcgtcattggctggtacgggtgacggtgaatgcctgcaaggatgccctgcggtcgccctggagacggcggatggtgcctctggacgactgccgggagccggtgttcaatacgccggagcaccagaatctctatgcagaggtcatggccctgccggccaagtaccgcttgccgctgtatctctattattatgaagggtacacagcggcggaggtgggggagctgctgggcctggggccctccaccgttcggacccggcttgcccgggccagagagaaactgaaagcacagctgagggaggagtgagccatgcagaacatctatcgggagacatttgagcagatccatgcctccgagcagctgcgaaaggaggtagccaatgtgccgaaacaggagaaggcagcgtttagacaccatatttccaaggcagggctgattgccgcagcgttggcgctggcgctggcgggcacggtcctggcagtggccagtcccaccctctggtggtggtttgagcagaagtgggaggaggagaccggcagctcgatgacggaatcccaatccctggtgatcgacggcctgacccgaaaagtgggggagagcgttaccagcggggacgtgaccgtcactgtggacagtatcaccgtgggcagcagtcagatctgggcattgctggacgtgacgggctgggactttgaccgagatgcccagtattcctttgacaggatgcgtgcggagatcgtccctgaccccagtgggggccagcatggtggggctgggtacggcctggacagtatcgggatcacccgggagggcgcagcccggatgctgctggagttctccgccaccatctccactggtaaccagctgaacagaggagattacgcgctggagatcgatctgaacgacctgatccgccgccgtaccggcggggcagaggatgaggccttgtgtgaaggagagtggtctttctcgattcctttggcggcagagagcctgtctcctaccatcaccatcgacagagttcaagtgctgtcgaatcacatggtctgggatcaggctaccggcaaagatggcggcgccttagagggtacagggggaaaatctcacccggctgttgcaacgctaacgaacctccaaattaccgcaacaggtgcctccttctactgcgacggactgatggaccggctccacgcaaccgtgatcctggccgacgggaccgaagtagagaaccgtggcggcggtggaagcagaatggaggacggcggatggtatgtcagctttgactggccggtgccgctggatgtgacggatatcgttgctatccgctttggcgatgcagaaattccgttgaattaagtgagacttgcaaagagcgccccgccaaaagcaggcggggcgtttttgtcactttcacgtttctatccagtccctctgccgccagacggcaaactcccgccggaccagcagcaagctcaggaggaaggtcagcatgtcggaaatgggggcggccagcagggcaccatccaggccgaaccggccggacagcagaatagccaggggaatcagaaacacgccctgccgggccaggggaatggcaagggagggtaccggccggccgatcccttgaaagaaagaggcggtggccagatgcaggccgtacaggaagaaggcggccatatacagccggaagcagtgctgggcacagtccaggtagagggggctgtcagagacgaacagcatcccgatctgccggggaaacagctggaacacgaggaaccacacccccgaaattaccagggcgatggcggcggccgtgcggaaggtctgccgcacccgaagaaaatgcttcgccccgaagttgtaaccgttgataggctgtacggcggaggagacgcccacaaacatggagtgggcaatctgatagaccttcatcatcattccgtagacagagagagcgatgtcgctgccgtacacgctggccgctccgtgaacccgcagcaggttgttcagggtgatctgtaccagggcagtgaggatctgggtcagcaggctgggaacccccagggccagaatccgcccggtgagcctaatggtggggcgcagcgcctggcgccggagccggactgtgtgcagccggggcaggtaggccagaaacagcaccccggccgccacctggccgatgactgtggcaatgccggcccccaccacgcccatgcccagagggaagatgaagacggggtctagaatcaggttgaggacggcaccggtaatcatgcagcccatgctgtaccgggggtggccgtccgcccgaatgatggcggtgaaggccgggcagatcagctggaagggcaggccccaggcaatggtccggagataggctgcagcctccggccaggcagtgtccgtagcgccgaagagccgggcaatctggggggcgaagcaccagctgacgatggccgcacagagaccgctggcggcaatcagggtggcggcgtgaccgatggtgtcatccgcctcttgctgctggcggcggccgaggcacaggctgatgttggcggcgctgccgtctcccagcagcagggccacggcattcaccagaatgaccaccgggaacgccacgttgatggccgccatggcggtgatccccacgccctggcccacaaagatctggtccacgatgttgtagaggcagttgaccatcagcgtcagggccgtggggatggcgtagcggacgatcagcttttgaaccggctcggtttccagcgggctgcgggactcctgatcggccgtcatacggatccctcctccggcgggcgcaccgcccgccgtgataaaaagtcccagcggcagagcaccgccctgcccactgggtaagcatcaatttttttcagcataacatgggcggcggtaaaagtcaacgcactggacagcggtctgttcacagaatgttttcaaagaagccgccggatgccggcaaccttttggcggccggacctatctatatggatgtacaggcggtgcggacaggcgtgcctgtccgcagtggctccgctgtacaaaatcacaaggaaaaggatggaacatacatgagaggattgctcacaggaatcctggcggcgctgatactgctgacgctggcggcctgcggctctgaaaagacggacgccggcaacgacgggaaggaagaggacagcgcaacggtcaatggtgtggtgaactgtatgggggatttcctggttctgcttactgacgatgggacttatcaggttttcgactttggcgaggatgtggatcaggggcgtcttgaagagggggacagcgtcacagttacctataccggagagcttgggagcgaggatccggtgcctgtggcggtttctgtggagaagacagatgcggtataaggaacgctttccataaagcagcggcccgcaaactgcgggccgctgctttttatcagggcagagagacctgggcaatcaggtcccgcacaacagcactgcctagcagcagaccggctgtggcgggaacccagggattgctggcgggcacactgcggcggccgggggcggcgcctccggctgggcgggagagacgggcttctccgggctgaacaccaccttcagatggtgaatgcctctggtccggagttccttgcgcatcacccgggccagggggcagccataggtcttggagatgtccgttacctggaggagggtgggatccagcttgttgcctgtgcccagggccgcgatcagggggatgttcagcttcagggcagtctctgccagatccagcttgcaggacaccagatcgatggcgtccacgatgtaatcgtaccggcagccctccgggaagaagcagtcccgatgagcggcgtcatagagaccgtggacaggatggagctctgcatccggattgatgtcccgcagacgggcggccaccgcctccgccttgggctgacccagggtggagtggagggcctccagctggcggttcaggttggtgagggcaatggtgtcgctgtccaccagggtcagctcgccgactccggaccgggccaagcattcggcggcgtagctgcccacgccgcccagccccagcagcagcacgtgggcccgagcaagccgggcctgggcctccgggccccacagcatctcgttgcggagaaagggatgttccataacggacctccttgttgcaaacaggtggaaaacgtccggctttgaaatttcaaagccggacgtcttgtgttgtgaatgggaatcaacccacaaagctcatgccgaaggaggactgctccgcagtatagccctcggtcttctcctcgtagaacgtatccacggcgtcattgaccagatctgcggacacctggatctcccagtagggctggtcatagcccacgaagtacatgacgtggtagccggtgctctcgttgtgaatgatgccggtgtcgccggtctggcgggcgggatcgaagcaccagtcgttgaactccgtcaccatctggccctgatagacctgctcatacaggccgccggtggtgttggacccgggatcctgggagtactcattggccagcgcggcaaaggagtcctcggtggcgtcgccggccttccactcgtccaggatgtcctgggccttctgcgcggcctcggcgtccttggcggccacatcgtcctcatagccctcgtcatcctcggagagctcggaggcctccggctggatcaggatgtggcgcacgttcaccgtgttgtattcgttgcgggagcggccgttaaagaccaccacatagtagttgctgctgtcgctgtcctccagcacggcggagtcgccggcctgccgggcatcgtcatacagccattcacccagaacagaggagctgtacgagaagctgtcagaagaggcataggtggcggtggactcatactctgcggctgcatcctccagagaggtgcccgccttgtaggcggcgtagatggcatctgcggtggtcttggcagcggccatggcctccgccttcatctcgtcggtgacctcgatggagttgccctcttcatctgtatcagctgcggcgccgttgacgcggacatacgcacagtccaccagatcgtaggcggtccggtcctcctgataggcggcctccagctcgtcggtggagtaggtcagactgtcctgataggactggagataggcggtggccagcaggctgcgccgggtctgctcctcatagatgctgcgggtcatggtgctgccgtagatgagacccagatactgcttttccgtatagccgtacgtgctggcagcggaggcaagggactccatggtgtcgtccaggtcggcctgcatctcgtcgttccaggtgaagccctcggcctctgcagcggcattcatggcctggacgccggccaactgctccagggccttgtccgcgaagtagtcgtaccaagtctcgccctcggtggcgtcggtgacgaacatgacggcgctggaggagatggtctggtccttcaaggacgtgccggtgtccagcccgatcatgctcagaatgctgtaattgccgttgacaaagttctgatagtagttctcaaaatagaagttgacctcagcggcggtgtacttctcaccgttgacggtggccgccgtagccgtcttgggaatgatgttggacttccagatgacggcggcaatggcgattaccaggaataccactccgatggtgccatacagaaggttggtgctgtgctccttctggcgttgcttggcctcccgggcggtcttgggatcgttccagccggagccggacaggtcctggcgggtctttttttctcttgatgcgctcatgtgtgtttcagtcctctcaagtattcaggtgcaaggtttgcaagaaaccggaaattacgcactttgatattatactggatatggccggattctgcaagagaaatttgcggaatccccgccgcgatccggcaggatcggcaaaaacaggggattttttggctgatccgcaaaaaaaagcggagcggccagaccgccccttcagaaaacgtgccccgcgagagccgtgtaggcccgttataacctgcaccttcacggccaggtgggttgcctccaacgcgctttaccacttccaacttccagccgcagacagcagccgggaggcctgcgaaccacgcgctgatccggcatcccgtataacgaaatgtgggttaaaaaaagacctatcacaaaccccgcagggcacatattcaccgtatcacatcccggcccgggatgcaagaggaaaccagcggacccggagagaaatttttgtatggagtgtcaggactctccgtcctcgtcgaacagggactccatgaacaggtcatagaccgcgtccagttcctcgtcggaatccagcgtggacagcagatcctccccgtcctcgtggaggaccttcaggatcaccagtccattgtccggatcctcatcctctccctctgtctccgcagggaagaaagcctggtactgctggccgttgtattccagcgcgtccacaaactccagcacgatctcgcggccgtcctcgtctgtgactgtgatgaaagtggggccgtactcatccgccatggggcgtcctccttctgtctgtattctaggggtattgtaactgactttccagaagattgcaagggggtgaacttttggaaatgtgggaaactggggcgctggggatggatttatcctgcccaaaagcagaaaaaccatgcggataagaaactttttttcggtaaaatacgacattttcgatattgacatgggatggtacaatagaacatattatggaggactctgagcctctgcggccgcagacaggcggcgcggcagactgcttttgcagaaaattcaaattcaaaagaaggaggtgctctgcattggaacgcagaagacgggagggatcccatgagatgatcccccgccgggaacccagacagcagaaaagcaccaaacgaacgggacacaaggtcgtcttcatcctggggacggtcctgctggtgggcatctgcacagtggcgatgcttgccgggctttttatgatgtacgtccggaccacactggcccctacgctggaggtcaacgccgacgactacaccatgaatctcagctccatcatctattaccaggacagggacaccggagattgggtggaataccagaccgtctacggcacggaaaaccgcatctgggtggactatgaacagatcccggacgcgctgtggcaggcggccgtagccattgaggaccaccgattctttgagcacaacggcgtggactggacccgaaccgcctccgccacgctgaacttcttcaccggcagccgggccaccttcggcggctccaccctgacgcagcaggtgctgaagaacatgaccggcgacgacggcaacaccatcaaccgcaaggtgcgggagattttccgggccctggagttcgagaagaactacaccaagcaggagatcctggagatgtacctgaacaccatctatctgggacagggctgctacggcgtccagaccgcgtcggagttctacttcggcaaggatgtgtcggagctggatccggcggaatgcgcctgcctcatcgccatcaccaacaacccctccctgtatggtcccatgtccaccatcaccatcacccgggaggacggcagcaccgtcacgccccgggagctgaacaaggagcgccaggagatgatcctgacccggatggccggcggcaatgacgatgtgggcgtcaccgggctcacctatctgacagaggaggaggccgaggccgccaaggcggaggagctgcatttcacggacggcaccacttccgctcaggacattgtcacggaggctaccggcggcgccaatgtcaactcctggttcgtggaccaggtgctgcgggatgtctccgcggatctggcggacctgtacggcatcaccgaaaaagaggccctgaaccggatctacaacagcggctacaacatctacaccacgctggacccgaagattcaggagattgcggagtctgtctacgaggaccgggggagtctgaacaacctcacctccgccagcggacagctgatccactccggcattaccattatcgagccctccaccggcaacatcgtggccatggtgggcgatatgggacccaagtccggaaacctgctgtggaactatgcaacggatatccagcagccgggttcctccatcaagccgctgacggcttatgccccggcgctggatgcgggggcagtctccccggcaaccacctttgacaactacccggtccgcctgctgaatgggaatccatggcccaagaactcgcccaacacctacacgggctggacatccgtgcgcaacggtgtcaaggcatccatcaacaccatcgcggtgcagacactggaaaaggttggggtcacggcggcctaccaattcgccaccgaaaatctggggctgagtctggcaccggaggatatgaacgtcagcccgctggggctgggcggcctgacttacggcctcagcacggtggagatggcggcggcctacgctgctttcgccaacagcggtgtgtacaatgagcccaagacctacgtaaaggttctggccaacgacaactccaccgtggtgctggaaaaggagacggagcagcgggtggccatgaaggagaccaccgcctatctgatgacggacatgctgcgccgggcggtgaatgagtccggcggcaccggcggcggcgctcgattcagcgggatgcacattgcaggaaaaaccggcaccaccaacgacaactatgaccgttatttcacaggctacacgccgtattactgcgcggcggtctgggtgggctacaagaacaacgagcggatcagctactccgtgaacccggcggcctccctgtggcggcaggtgatggagaaggtccatgcggatctgccggacaagtccttcaaccgtcccagtagcggcctgacaacggtcagtgtctgcgcggacagcggcatgctggcgacggatgcctgccgcgccgattccagaggggaccggacggtatcctatgaggtggctgtgggcacggagcccacgacggagtgcacgctccacaagatggtggacatctgcaccgagggtaactgcttggccggtgagttctgcccggcggagtccatcgtgcagaagggctatctggactatgtgcgggaggattacggcgagagcatcactgcctccgacgacgcctatctcatcagcaccctggaaaaggcggtggcccccacggagaccagccccggcggatgtcccgtccacacgtcggctgcagttacggaccccgatgacccgaatggggggctggatcccagcgatcccaactggcagccgcctgatcccaacgaccctgatgtgcccatagatccggatacgccgacagaggacccctccggcggcggagaccagcctacggagccggatcccaacgatcccagcggcggctttggagacgccggcggcgattggtggagcggtttctggggagacaacacaggaacatgagaaagcggcccggcgattgccgggccgcttcactgtgtccagtgggaagttacaggttcttctcgtaggactcgatcatcttcttgaccatctggccgccgacggagccggcctcacgagaggacaggtcaccgttgtagccttccttcaggttgacgcccacctcggcggcagcctccatcttgaacttatccatagccgcacgggcctcgggaacgttgatcttattgctattcttgctagacataattgaatctccttttcatcatacatttgttgcgtgtgggttactgggtatcgcgagcatagtttgactccgggacgggagaatatgcggtttttctggcggaaaaatttgttggcagggacgtcttggagaaaaatgtcatagatttgttacccatcggaaaggcggattatgatataatctcaaaaaacaaagggaggcactggcgatggagggcatctgcgggcgaatgtgcgacgcatgtacctggaaagagcagctggactgtcccggctgtcaggatgggccggggcgccggttttccggcggctgtcccattgcggactgctgccgggagaaggggcatacggcatgtgtgacctgcaccttttctaccggctgtgccctgcggcgaagagatatgccccagaaccggctgtgggccgtggaggcagagcgggagcgccgggcgcggctggaccggaatgcccctgtgctggccaagtggctgtggctgctgttctggctggtgactcccagtgttttcagcaacattctgaccatggatactgtggcgggagcgtttccaactgccggagtcgttggaaatgtgctggcatttctgatttccctggcctatggtgtccttttgtggcagctgcgggaggcggcaggccggtaccgcacggcggccctgtgctatttggctggcggcatcatcagcggtgtgctgctgcttccggcaattccggaggggaactggctgtggtggctgctctccctgccggtcatggtgctggagctctgtgccgcatatcaggagttttatgcccatgcagaggttttggaggagcttgacccggagctggcggggaagtggcggctgctttggaaatggtggatcggcctgctgctggggttgtttggatgcatcttcctggcattgatttcggcaattctgggtcttctggcgatactggcggacgccatcggcctgttggtggtggggatcgtgaagctggtctatctctaccggacagcaaagcggttccgggaatatcagccggcggcactgcagaaggaggttctatgagattattgttcagacagcggctgttctcctggtttgacagctatgacatctacgacgaggcggggaacaccgtctacactgtggagggaaagctggcctggggacactgcctccacattttgaatgcggcgggagaccacatcggcactgtgcgggagcaggtgctgacctttctgcccaaatttgaattgtacgtccaggatcagtatgtgggctgcatccaaaaggaattcacatttttcacgccgaaatttgacatcgactgcaacggctggcgtgtggagggcgacttcctggagtgggattaccgggtgacggaggcctgcggggcgcaggtggcgtccatccacaaggagctgctccactggacggacacttacgtgatcgacgtggcggacccgggcagcgcgctgtgcgtactgatgctggtgctagccatcgacgcggagaagtgctcccggaactgagcgccgcccaagaatgaatgtaaagcacgccgccctttcgggcggcgtgctttacagactgcggatttggttttggatgagggaacccaccgtgtcggcgaactggtccagggaacggatgcgggcgaagttccggccatagacggtgtgggcggcgggcaggtcgtcgtcattcccggtgaaaacgcacatgacgttgatgcccttgtaggtcagggaccggatctccatggcggtgttctggatgccgttgtccgcggcgtattccacaaagcttccgctgtggttcatctggatcacgtcgttgggtttcacgtcggagaggaggattaccagcttgtgttcgctgggggagtcttccagtcccttggccaaggcccggatggccaggccgtcccggttgcagccggtggtgaagtaattgaagatgcggtcgtttttgcccgtctcatagtagtcccgatagcgggtcaccacggtgtatccgctgagggagcagaaggaggatactcgcaccggaatgtggcagcgggtaaggctttcggcaatcatatagccttgggcggccaccaccgcctgccggtcgatctgggagctggaggcatccagaagaatgtccaccgacaggtcgccgggatccgactggagaatacgggtgaacaccttgtcgtcgtccaggtacacgccccgccagatgcggccggcatccagcgcgccggaggcggcacggacaggggtgggctggagataagccagcatggcgttgcggatgcgggcggtgaggcggcggatgctggtgcggtggcgggtggcgtcggcttcgtaggcggcccggttcagctccatctgtcgcagggcgttgcgccgctgggcggccacatagcccttgagcttttcatgagtgtcgtctccggtggcgtagtacaggtggcagccctggtgctcgtccacgcagagctcccgctccaggctctccagctgcgactggtcgtataagggggcgccgaagtagccccgcatgtattttcgcagggcggcctccgtctgggccaggttgtagtccgtcaggcggcgctggaccggctctgcgttggctccgccgccctggcccttcaccagatgctccccgaacccgtggccaaaggcccgcacggcgggcagcaggtccgcctcggaccggcggcggaaggcgaagagggggcggcgccgtttccgctcctccgactcctgggcctgggtctcgccgggggtgaaatggaaataggtgtggaggaatgccagggcccgctccgcaatggcagggccgtccaggtctccggggaactccagggcatccagcatttcccggtccctgggcagcaggggcggttcgctctgccccagggccctgcagaagtgggcgttttccagcgtggccagcaggtcgccgggatctgcccgctggtccagagccacggcccggcgggcatagctccgccgcagggagggcagcgccggccggcggggagcctcccgctggtagacggcgttttccagccccagccacagcagctgctcaaagagctgttccttggagcagccgtggagggattcaaacagcccttctatggtctctgctccgtaattcttccgcacggcgccgatgatgctgttccaatacaggtctgcacggccatcctcgtcgtatgccttgaagtctggctcaaaggagtaatccgcagcggcgttccagatcaggttccgggcccgccgcttctcactgtccaggatctccatcagtcaaacacatcctcacggcggagcgtctccggcaggcgggtgcggatcacgtcccgcaccagctgccgctcaaagtcatcaaaggacttgttgacaaggcccagatccagcgcccggttgccctccagcccggtgcgcatcagtcgcacggcggccagcaggccccgcaggtccagaggcttggtagaaagctctccgccgtcgcatttcttctggatgtcctggaacaatccggcgaactgctcggcatacacgcctttcagagaggggaactcccgcttcaggagcttgatgagcccctcggtggtgatggcgggcatgtcgatcaccacgaaccgggaggccagagcctcattcagctcccgggtgccggcgtagccgtagttcatggtggcgatgaagcgggtggcgtcgtgaaggggaatgcgttcatagccaggcatgtcgatggagcggcggaagtccagcgtggcgtggagcaccgccaaagactcgttcttggccatgttgatctcatccaacacgccgaagccgccggtctccgcacactggtagatggggcccttccgcagctgtacggcgccgttttcaaaggtgtccgtgcccagcagggtggcggcgtctgtgttgatgtagaaggacacgttccagctggggcggccgaacacggtggccaggttttccgccagcacattcttgccagtggccttggggcctaccagcaacaggttctctccgcagaggatggcggtgatggcctcctcccagatgtcctttccataatagagataccggggatcggggacccggcgccgcagggtctcgtcctcctccggataggcgtcccgaaatttttcgatctccgcagtgatgtcggcgctgacgccttcatcccgcagaaattccagcatatccaacatagtgtgaacctcccgtgttttctgactctatcatagcatgattcctgaaaatggcaagagaaaaaggcgcgcccgacattcaccgggcgcgctgaaaggatcaatctgtattctccaggggaaaagtcacttgccagaggccctccgtcagggtggcggcggtatagaagttgccgtggagggtgcatcctgccagctcctccggcgggacggcaaagagaaagtccatataatccgtccggccgccagccgtctcacctgtaaaataagagataccggtacaatggaattccctgccgtcggcatcttccatccacaaaaacgcgtggttgtccgtcctggaggcgtctccccggcacagctggatgtggaagaggccgtctgcgtaaccggcggctgtgatgggcaggccctccgcgggctccgccaggacttcaccgggttgcagcattacggaagccagatcgccgcttccaccggtggcagagtaataggtcacctccggctccctcacccctgcggcagggggatcagccccccaggtgagggcggtctccgcctcttgggcatagttcgtcagcttcaggtccaccgtcacgccctccatcgccttcttgcctgtcagcagctgccggacggagaaggtcatcttgccgccggtgggaatgggggagccgtccatggttttcacagtgcagagaaaagtgactgtcccggtggcctcgtcccaggccacccgctcacagcggccggtctggtcaaagggcaggtggaaggaccaactgtcaaacaggtctgtggtggcgtccacaggaccgccggagaggacgatgtacgcctgggcagtgtctccctccacccggacggccgctacctccatggtgatgccgctgtccgtgcaggcttcctgtatcggctggaagaactgggctacggcgggggcaatccggtataaaaccgcatatcccgtctccgaccggaccgccagggctggggtagccagcagcactgccgccacggcagcggccgccgccagccggcgcagggggaggcggtgtcggtcagggtgggagagagtcttgcggatcaggtccggcgacgggccgacaggctcgttcatccggcggtaggttttggaaaagttcatatatcctccttcagcaatgtccgcagcttctgccgggcccgggtcagctgtgcccggacggtggagggagaccggcccagaatccgggcgatctcctccgtctgatagccctcatagtagaacaggtggatgacggcccggtatttgccggggagatgggccagagcctcgtccacagcggattccacggagtcttggtaggaatagacatcctccagcgggagggtccgcatccgccagggggaggccagcaggctccttgcgcagttggccgtcacccgtaggagccacgcacgtcggtgttcctcattcgcaaaatccggagcggaccggtggagccggagaaaaacctcctgaaacacgtcgtcggcgtcgctgcgggagcgggtcatggcgtaggccagccggtagactgcggagccgtattgcgccacggcttcggcggtatcgggcatgtgatcacatccttctgtaaggaatacccggcagagggcggaattgctgcaaagagaaaaaacattacatttgttttggcgggaatgttgcgtttggttgcggcggtgtcaggtggctgtggtggactttcccggcggcgcttggtatgatgggaccagcgaaagagactggaggaggaagactcatgacctttggagagaagctgaccgggctgcggaagcgggaggggctgagccaggaggccctggcggaacagctgggcgtctcccgtcaggcggtgagccgctgggaacagggggcggccctgccggacgcggcgaaactgctgccctgcgcccggctgttcagcgtggacgtggaatggctgctggatgaggaacaggatggggaggatcggctttcggcggcggagttcctgcagggaacggaaaggccctctgttcacagagactggccctggtatatcgccggcggcatcgtcaccggcgcgggttctttgggtatggtgaccatggggattctgagcgccgtctttcctgtcgtggtttccgaggctccggcgggggtggagtgggtccgcatctacaccggcctggctggttttctgaaagctcacggcgtagagtggctctttgccctttgggcggcggtggccctggcggggctctggctgctggcccagccgcctatccggcgacgggaacagacggcctcccagttttcctcctggtacgccgcgggcgtggcggtagggctgtacggcgtcggtcagaccgcctggtatgtccagctgggcaagctgagagacctgcctgtgctggcccttttcctggcggcggcggtctggtgcacggtgcggcagttttggcggctgggcggggagccggacgagacccgcaggcggcaggaacggatcattgccctgctatacaccgtcgcacagggagtccttctcctgctgacggcggaggcgggctttggcctggtggcgctggtgctccatattggggtgtatttcatctgcgctgcagccataacctggaggcggtccggcaggggaaagcactaaacacaaaaacaggaggccggtctcccggcctcctgcctttgtgtctgttcggttatcccatcagataggcgtacttggtcagcaccgtccagatgaacacctcgatgtcggcgggcaggtcgttcttggcgtccagatctgcctcgaacaccttgctgtccaggcgcaccagcaccttcttcccgcccagaggcaggaagccctgattgtttacactctcgtcaaagccctcccgggtcaggaacagggtgaacttctcccggtagggggcggagtcgtaggggcagaacacggcgcagttgccgcactcgttgcacatccggtccacatggaggatctgctggcggccgtccggcagctcgatgaccacattggcccggttggggcacacgtcggcgcagacctggcacaccacgttgcaggtcaggcaccggttgccctcgcacttggcgctctcgcagaggacgcccttcttggcgacggcctcctcccgggtggctacggccttggcggggatggcaaacttgtgggcctcgccgatgacggcattggcgaaatactgggcgtcggcaatgccctccaccacggtggcgggcccgcgcatggcgtcgccgccggcgtagacgccctcgagattggtcttgaaggcggggatgcccttctcgtccacggtgatgccgttccgggtgaaaacctcgctctcaaccttctcgcccacggcggagaccacggtgtcgcaggggatctccaccatttcgccggtggggacgggcttgcggcggcccttgtcgtccgggtcgcccagcttcatcttctcacaaatcagcttgccgtccttctgctccacaggggctaccagctccaggaactccacgccgtcggcaatggccatctccagctcctccgcatcggcgggcatatacttcttcgtccggcggtacaccagggtagaggatttggccccggcccgcagagcggcccgggcggcgtccatggcggtgttgccgccgcccaccacggccacatggcccagggagacgtccttacccgccttcatgtcgcgcagccagccgatgaccggcaccacgttgccggggatgtccagccgtccggccttccaggcgcctacggcgaagaagatgtgggtatagccctgtgccttcagctctgccacagagggggcctcggtgttcagctttacctccacgcccatcttctccatcagagccacgtccttgtcgatagcctcgtcgctgatgcggaaggcggggatcacctgccggacgatgccgcccaggcggtccgctttttcaaacagcgtcacggggatgcccgcccggcccacgaagtacgccgcggacatgccggtgggaccgccgccgatgacggccaccttccggccgtccgtcaccggcgcgggaggcgtgatcttggacatgtaggcgtcatagcccttttcggccgccaccagcttggtggcgcggatgttcacgggctcgtcgtaataattccgcatacacttggtcatgcagttgtgggcgcagatggtgcccgtgatgaaaggcagggggttcttctcggtgatgagccgcagggcggaggcgtacgcgcccttccggcacagctcgatatactccggaatgtcctggtggatggggcagccgcccttgcagggagcggtgaagcagtccagcaggggcaccttgtcatacagcttgcggcggggcaggggcttgatggctttcacatggtacttgtcggaccgggccgccagagagagggcctcgatgccgaccacgtccacgccggtgaagggcttgaagtccagagcgtccagcttgtctccgatctgggtgaaccgctggtagccgccgggcttcagctcggtggtggccatggtgatgggccagataccgcaggcgaacagcttgtcgatgttgaaggcgtcggcaccgccggcataagagaggcgcagcttcccgccaaactccttggccatcatggcggccatggtggtggtcagggggaagagggacttgcccgccatgtacatctcctcgctgggcagttccccggccttcacgtccacagggaaggtgttggagagcttcaggccgaattccagcccctccttgtctgccagggcctggaggcggtggaacatgggcaccgcgtcggcgtactgcaggtcctccttgaagtggtgatcgtcgaaggcgatatagtcatagcccatggagtccagaatggaccgggcggtctcgtaccccaggatggtgggattgcacttgacgaaggtgtgcaggtgcttcttctccagcaggtagctggcgatccgctcgatctcgtccggcgggcagccgtggagggtggacaccgtcacggatccggacacatggggagtgatcgtgtcgatataatcgctttctcccgggaagaactccttcaaaacagcgatgcactcctggaagatgggcgtcttggaggcgtccaccatgccgttcaggaaggtgtcgatcttctcaccctggatgcctgccaggtcatagcccacggacatgttgaacacgaatccgttgggatcgcccagaccatagacctttgccatgatcttcagggcgcaccaggccttcacatactcctcaaaggcctgctggacatacagctccgtggaccactcgcagttgtagcactcatcctccgccaggatgcaggggcggttgatgcaggcggccagatccgcgccgtccatcttctggacggtcttcagctcgaagaaccgggcgccggcgaaatagccggcaatgatgttctgggccagctgggtgttggggccggcggcggggccgaacggagtctcgatggtctccccgaagatggggagcttcttcatgccggccttgtagggcttgtggacgccgaacacggcgccgtcccggcggtattcggtggtgatccaggtcatcaattcccgaaagggaatgggggtcattaactcagacatagtttttcctcctcagaataactcctgaaatacgaatgcgcactgcttccgcaggggcacatcggccggtcatcaatactccttgtggttcagccggccccacagacgcttgctgctctccagaatgtgggcattcacggcctcctcgtcgatctccgtcaggacccggtccttcatcaggattctgccgttaatcatggtggtctggcactgccgccccgtcatgccgaagagcatgtgtccgtcgatgttggcatcagagaacggtgtgaagggcttgtagtccatgacgatcacgtccgccgccgcgccgggcttcagcacgcccagagtggggaagccggtgcgctccgccatcttggcgttgttgcggaacagcatgtccgtcacctcgcaccagcccacgttgggcatacaggcgttgtgccgctgggagcacagggccaccttgatggactccagcatgtcgttggtgtaggcgtcggtacccagaccgatcagaatgcccttcttgtagagctgcagcaccggagagatacccacggcgttgcccatgttgctctccgggttgttgacgcacatggtgtccgtggccttgatgatatccatttccgccgtgttcacatggatgcagtggcccaggatggtcttgggtcccaggatgccgtggtcctggagccgctggacgggccggcggccgtagttctggagggagtcgtacacgtcgttcatgccctcggacacgtggatgtgatagcccacccggccgctgttggccgccgccatccggtcaaaggtcttgtcggagatggtgaacagggcatgtccgccgaacatggccttcagcatatcggaggggttctgctcgcagtagtcgatgaagtccttgttctcctgcacggactgaagggatttctcctccccgtcccggtcgctgacctcatagcacaggcacgcccgcatcccgaattccctcgtcacctcggcgatccgcatcagggagccggggacctcacagaagctggcgtgatggtcgaaaatggtggtgacgccctgcttgatggagtcgatcaccagggcctgggcgctggccttggtggcctccaggtccagattccggtcaatgtaccaccactggccgtccagcacctcatagaagctggtggggttgtacccatcgatggagaggccccgggccagggcggagtagatgtgggtgtgggcattgataaggcccggcatgatgacgccgccacgagcgtccacaaattccgcctgggggtacttggccttcagatccgcggtggtgccgacctccacgatcttgccgccatcggtgaccacgccgccgtccggcaggtagccgatgccctccggatcccgggtgatgaccttgccgtttgccagtaaaatcataaaaatgacctccttttgtccgtcttttgcatatctgataaaaagaaaaggcgcttcaaaccgctgtcggtttgaaacacctaccaaaagaccggaatgataggtgtcagcccgtgcgcgcagcacttcgttgcagctatcattcttcccttgtacttgtattttaccggacagcagcctaaaatgcaagcagggaagctcaaaaattttcagatggattttgtgtagtttgccggaaagcggcggaacttattcccaaccgggtccgtctacatgaaatgaaataaagaaagcgatggaatcagagaaagaggaggcgtcagaatgaaacggctttggatttgcctgctggcttttgcgctgctgacgggatgcggcgattccggcgacattgcggtgacaacggtatacgaaacagatgacccgccccggaccgccctgaccacggagtgggagacttacgacccgtcggtggagacggtgtggtgcatcctgtcctatgagggggaaggggaatctctggagtatggggcgccctattggctggatgtgcgggaggcggacggcagctggacccaggtgcccctggctgagaacgccggatgggatgccatgctgtataccctgccgtccggtgaaaagcaggcgtttccgtgcatcctgtccctgtttgactacgacttctccggcggcagtacgttccgcgtcatcaaagagatcggagaatatacggccgcggcggagttcaccctgacaaagggggcggtcatctccgcagagacgccttacggcttcggccccatggaggaggtgccggagtacggcgacccggcggagctctccgccggcggtgccgtggtgtttaccgaggcgggaacggagaatgcggatgcggcggagatatttttggagaaggtctccctgggcatcccctgccagctgcggacccttcagaactactatgagagctggcccatgctgatcgacgtcatctatgacggccgcggctttctctggcggatgcggaccggcggagagatcacggagaaacgattttcctacatcgtgacggacggcacggacgtatacctctccaacggcgcagactgggagagcacagaacagtacgacagtgagaaggcgtttctgctgccctccggctccggatccttcctggtacccgcggcggaggcgatgacagatgaccggctggcggaaaataccgcccgctatcggatctggtcaggcgacgggatgcgggctgcttccctgacggaggaccctgcagaattcagcgtcatacgctgtgacccggagagcggaacatggagcaggtcctggaccatccgggagctggatgaccgggccacggcagtgagggacctttcctggctggaatccggagcactcctgcacatcacttatgaaacggagaaggacggcacgctgacggttgactttgtgccggacgctgaactgactgatcccggcgatctctgcggctatccggcggaatagagactgcggggccggcggtttgccggtttttccgtagaatactgcaaaatcttgggattttccattgacaagggcacaaaagctctgatattctattcgggctgattgaaacgatttcccgaccattccccaacattaaaaaggagagagatgcacacatgctgggagagatcattgcggatttgagcaactggatgtatacctacctgctggtgattctgctggtggccgccggactgtttttcaccattcggaaccggttcccgcagctgcggctgctgcgggaggccatccgcgtggtggtggagcggccggagaaggagggaagcgtgtcctccttccaggcgctgatggtgtccaccgcctcccgggtaggtacgggcaacattatcggcgtgtccgtggccatctgcatgggcggctacggcgccgtgttctggatgtggctcatcgccctgctgggcggcgccacggcctttaccgaatccacgctggcgcagatttacaagcgccggaacccggagaccggcgagagttacggcggccctgcctattatattgaggcggccctccacagccgtcccctggcggtgctgtttgccctgagcctcatcgccacctacgccggcggcttcaacatgctctgctcctacaacctccagtccaccttctccggatacagcttttattccccggagtggacgccctggatcatcggcggcatcgtggcgctgctgaccgggtactgcgtcatgggcggcggcaagcggatcatcgccttcgcctccactctggtgcccatcatgggcggactgtacgtgctggtggccctggtggtcatcgtcatgaacgtggggctgattccccaggtgttcggacggatcttctccgaggcgttcgatttccaagccatcttcgccggcttcaccggctctgccgtgatgcagggcgtgaagcggggcctcttttccaacgaggccggcgtgggctccgccccaacgctgccgcctctgccaatgtcagccatccggtgaagcaggggctggtccagatgctgtctgtcttcctggacacgctggtgatctgctccgccaccgccttcatgctgctgtgctccggtgtggagcccgcagtggagctgcagggcgccccctatgtgcagtcggccctggccgcctccttcggcaccctgggtcccgttttcatcaccgtggccatggtgctctttgccttcacaactctgatcggaaacctctactatgtggacaatgccctggcgtatctgctggggcacgtgccctccaagcggttcatggtggtgttccgcctgattgccatgggactgattttcctgggcgccggcctcacgctggatctggtgtggaacctgtctgacgtgctgatgggcgtcatggtgctcatcaacattccggtgatcgcggtcctctcccgtccggcggcggcagccctgcggaactataccgagcagcgcagggccggcaagaaccccgtgttccgggccgcggacatcgacctgaaggaaaagaccgaatactggaactgaaataaaaacggcagggctttgaaagcggacgcttcggcgtccgctttttttgcatagaatggaatagaaacagaaaatttacaaaaactacttgaaataaaaaacgaaatcgcttaatataatatcgaaaactatattatatgatgcggacggcatgatgccggatttcaagaaggagagaccattccatgcgcaaactgtttgcaaaggcccaggaccccatcagctgtgaaacccatgcgctcggcgcggtggccgccctggggggcggtctgctgtatctgcttcggggcgtctggacggatgcggccataccggcggtggcggcggccctgtgcttctgtctgtctatggcggcactgtatgccgccagcgccatctatcactactatcccggcactgccgccagcggcggagtgaagcgggtgctgcggaaaatggaccacagtatgatctatgtgctgattgccggcagctacacgcccttctgcgtggtgctgctgccccagcccaggggaacacaattctgcctgatcctctggggcgtggccctggcgggggtgctggcgaagatgctgtggatcaacgcaccacggatgctgtccacggcagtatatctcatcatgggatggtctgtggtgtttgtggcaaaggacttcaccgctctgggccagccctgcctgacgctggtggctctgggcgggatctgctactcggtgggagcggtgttctacgccgtcaagaagccaaacatctctgcagagtggaccttccacgaactgttccacctgttgattctggcggggtctttcttccactatctggcggtatatctgtatgtgctgtgacgcagtggcgaaaaatctgactgaaaacgaaagcagcccggcggaatatccgccgggctgcttttggaatctgtgcaattggaacactggcgctgtttattgcgggctttcatccggtatcggaaggccgtgcgactccatcaagccgtacgactccagcagagcttttgcctcgtccagagatgctgccggagcgacatagacggaggagccggctacgtaggttgacgttccgtcgtcctcgccggggacccgctcaaaggggaacaggaagaactgcgtatattcccggtctgtgtacagttccccgaaaaacgtgtgggcggggaactttccgtattcgagcaggccccggttgaggccgccgccctcatgggccatggtcagccagaccttgctggcttcctcagaggtgaagggctgttcctccagttccagatagccgctgaagctgtcatcctgcccccactgcttcaccatctccccgtggaaatgcagagtggtgttcacggccgtggcctcgccatcctcccacaggaccgccgggagtgtcacgtccacctgtgaccggaatttcaccatgcgggcaatgaccagtgcggcagcgagaatcagtaccagacagatcaccgtcgtggcccggttggggccgtgccgtttggcgttcgtctgctctggggccatggtatgctcctttccgccggacgggaccggcctgccgtgcatcacacacgtaaagggagagcgccttattttgtcccgaagatccggtcaccggcatcgcccagaccggggacaatatagccgtgctcgttcagatggtcatccacggcgccgcagtagatgtccacgtccgggtgggccttctggatgcgctccacaccctccggcgcggccagcagaaccatcagcttgatgtttttgcagccccgcttcttcatctcggtgatggcggcctcggcgctgccgccggtggccagcatgggatccacgatcatgatgtcccgctccgcaatgtccttgggcatcttgcagaagtagacatggggctccagcgtctcctcatcccggaacatgccgatgtggcccacacgggcggagggcaccatccgcagcacaccgtccaccagccccaggcccgcccggaggatgggcaccacagcgaacttcttgcctttcagggtgggggcgatggtcctgcagatgggggtctccacctccttggtggtcaggggcagatcccgggtggcctcataggtgatcagcatcccgatctcggagacgatctcccggaaatccttgacgctggtgtccttgtcccgtaggatggtcagcttgtgggccaccagggggtggtccatcacatgcactttgccgctcatacttataaactccttttctctgatatccttgatgtaaaccgttccctacgatctaaaccgttccctcagatctggggcggctgccgcagacgctgggcctggggagggcggagatagaccggaagcaattcctgggcggagaccagctttcccgcccgggccaggtcctcggcgcacagggccacggacatggcgttctgcatcaccagttggggcggtgccaggcggcagggcagtcccgactctgtcagcgccttctcacagaggacggcgccgtcccccacgatcaccaggggcagtggctcgctccgcagctcctccgccagctccgcaaggccgatggcgcgatccggcgtccggcgggtcaggcggccatgttcggaggtgaagagggcgttgtagatctggctacgccgggcgtccatggcgcagaccaccagggcgtccatgtgggccacgttccgggccatggcctccagggtggagacggccgcgcagggcttgtccgcggcaaaggccagtcccttggcagccgagacgccgatgcggatgccggtgaaggaccccgggcctgccgccacagcgacggcgtcgcagtcctgaacggtcaggccggtgtttttcagcatggcctccacaatgggcatcagggtgcggctgtgggtgaggccggtgtcctgatagccggagcagaggactttcccatcctccgtcacggcggcggagaccgccttggcggaggtttccagtgccaagatcctcattgtgcagcacctccttccacggtgatgctccgccagccgtcgtgctccggatggcgggtgagggtcacatagaccgtgccctccggcagggcgtccgccacctgctcgctccactccacggcgcagacgccgccccgggagagatagtcctcccagccgatgtcgaacaggtcctcagacccgttcagccggtacatatcgaagtggaacagaggggtagggccctcatattcgttgacgatagtgaaggtggggctggtgacccgacctcggcatcccaggccacgggcaaggccacgggtaaaggcggtcttgcccatgcccagaccgccccggtaggccaccacggcgccgggagagagagcggcggccaaccgttcaccaaaggcctccgtctccgcctcgctgtgggaaatatactccacgaagcagcgctcctttccagtgatatttccaaatccgattcagtataccatattttgaacagtctgtaaaatagaaactataaaaatcaatggttctgtgttgttgctgtgaattagctgtgaaattagagaggccagggcaaaaaagccccggcttttctttgtttgaaaggcatgaaaacccgccccaggaagccccggggcgggcaacggtttatcctacaatcaggtcatcaggtgcaatctcaagataccgctccaaaaactcaatatcggagcagggcgcaagctcgttatgcacggcctcgcgggcgtcgtcatccatgtactcagccatagtgtcaaggctgatttcctccagcgcctcggcggccgtggtgtaggttgcgccgttgttaatgctgatctgtttcatggcttttgatcctttctcccgctatgcgggctccgttaaatttgattgtagcatccatccgagggagcgtcaatgctcccatatgttgttcctcctgtttgatttgtcgtggttgctgttcgctataaaagaaaggcggcaccggataccggcaccgccttatgtaatcaggttattcacttcaccttcgggagcggaaacttgatgacatttccgcactcttccgcccaatcaagcaagctgttaacgcctgcccttgtgacctctgcatgttcttccagcttttccaatctgtcgttgattttccgaagttcctcttgctgggcctcaagcagctgcaggatcttttcctcattgttcactctgcatcacctcatgctgccattatacggtgccgatattcggttgtcaaggtgccgccgcccgctgcggtgttccgctttggatggtttaatcatagcatcatgtacatgatattacaagatggcaaactccacaatcatgaacatgataatttgtgtatttttatcatggacatgatttttgggaattcgtataatatagaataagaaagtgggtgaaattgtggaagaaaagaaagttgattggagaaataagtggcaggctgaaaaccaagaaagaatcatacttatgacgccaaaagacccgcggaagggcccgacaaaagctcagatcaaggaggcggccagaattgctggaatgtctgttaattcttggcttttagagttggtgagtaaggagctgtttggatgagggaacgcaaagcaagacaatacaacgagttcggggaactggtttatcaggttgggacacagggcggaggctccatggcggaggatgtttccggcgtcagaatgccgtcaaacaaggcagaggcagaatgtttcaaacttttgcaggacaatgggtggacgccaaccaaacgaggatggccggacttcttctgcgtcaaaggggatcaggtgtgcgctgtagaggtgaaaccaagcaaaaattgcacactgaaacagaaccagcttgttatcatgggcgcactttctgcaaagggcattcgttgttttctctggtctcctgatggtggctttgaagaagtcatgggcatgacgaagccagcagagcagccgttttaattatctttactgtatctatacagaaataccaggtacttcttgtacctggtattttaattattatattattatattattatataactccccgtaggggagtttaattattatctctgtattttatctgatctgtactgtatctgtattgattattaaatcaggtggttttcatgggcagacaatgaggcaataagaagagcaaggggattttgtacaagaaagagccgtttggaaatacttaaaaaaattgaattaaattgatagaaaaataacaaggacgcaattcggaaaactgggaattaactatttgtttaaatgcaaatctagtgtttgcaatggttttgtggttttctgtgtaatttttgtgtcggttggccgccctggctgcgtgtgcatcatggctccgacccgcggcctgcgtgggcgtggctggcctgggggcatgcggccggggctgtagatgatggataacaaggggggaggggtagcggaaaaacgggcggcctcgctgggaacggcataggttatatttcctacatcccctcaactctctacaggtcagggggataccggaaaaacgggtgggatatgttctgaaatccggccttaaaatactattatcgggtacaaaacaggggtgcataaaatatgctgaacgatttggaagcgatctgtggtagagtatagataggcgaaagcctaccatcttcttttctcacctgcggcgggcagggtgttcctccagccctgccctgaccgcggggcttataatggggactagaaactgggggaccgcaccagagtttcgcaatcgaagccgatatgcggtgcggttgccctaccgcttgtgttgacggctgcgttcctacgtggagagagcagcggtggggcgattttgatacaaggcggtgaggacatgccgagagcgaaaaaagcggctggggagccggaagcggagaagcggacgggagcgggggcaaaatatgcaactgcggaggaactgcaggaaaagctggacgcttactttgcagagtgtgaggagcgcggcgatgtccccgaggaattttctcttggcgtgtacttgggtgtttcactcatgacgctggataactggtacaatggccgccgctgcgaatacctgcaggagacaatccagatggcctacatgcggatgtccgccgctgctgttcagatggcgtaccggaatccgaaagccccgatgccgatctttgcgctgaaacagaagcggtacggcggatatcaggacaaggtggaagccaatgcagaagtgaaagtcagtgtccagatgggaaagaacatggaggcgagtgatttcgcatgatggagtatttggcgtgtttcctgtttggtgctgtggttgccctgaccggggtaaaggtcggctccttcacaaatggaggggagcggcaggaagcggcggcgaagaagaatccggacccgcaggcagaagatgacagggacgagcagcgccggtccaaggagatcgacgagggcatccaaaacctgatgacattttcagtcaatggcaaagatggctttgatgtaggaggtctgtaatggcatctgtgcaggatgtttttgatatggcgatccatttgatggatgcgcagaacgagtccacaggcgcgacccgtacaacagatacgaacgaatatgcgcttcggacgccaaacatcctgaacacgctgctggatcaggtctatccttacagtgacacgtatccggacctgtcggatgggacgaaaacccgaccatctctggtcagtgtgacgtctctggatgactacctggacctcgatgactacatctgccggaacgttctgtcctatgggttggccggattgctgctgacggaagagaaccccacacaggcgaacttcttctggcagacatacctggagaatctgaacacggccaaaagccgtctgccatcctccggcatcgagagcgtggaggatgtgtacggcggaggcggtggagacaactacctttctcgctggggcggcattgaatacgggtggttcggccaatggtagtacatggatggtacacctgccccaaatgccataagggtatccagaaggtgacgggaaacacggttctgtatgggacgccggtatactgccgcaagtgcaggcgggagtggtggcccacaatcttcatggggcaggagatcaccggaaatttgccggagttcaaaatgaaataacaagctagagcgcaagacgccagagctgggaatgatcccggctttggcgtcttttttgttttttctgagcaagacgcccgagaccacggacgcttgaaatacacgccgccagaccaggcggggaaagaaggaaccaatggaagagaataccaccggtttggagcaggagaccgagaccacggttgactccttcatggatggattcgacggggcggagactctggaaagcccggcagaccagccggaagaacaggagccgaagcatgaagaaacacctgctgatgaagagcaaaaggcgccggaaacacctgctgctggcaacgaaaacactgacgccaaaccgggcgaaagcgttgaaccggagaagcaggaggcaccggaggcccaggaaccggagaccacaccgaaaacctggacgctgcgccatttaggcgaggacaagacagtcaacgaacaggaactgacggcccttgcccaaaagggcctggactatgaccggattcacggcaagtatgaggaattccggcctgtgatggacctgttcagccagtttgcgaacaaggcaggcatgaacaccacggactatattgcccacatccgccaggaagctaagagagccgaaggcctgaatgcagaagaggccaaaagggctgtggagctggaggaccgtgaggcaaccgtagccgccaaggaagctgctgaagcggagaggcagaaggagcagcgggacgccgaggctcagaagcagtccgcggagcagcgcaggatggcggatattcaagagtttcaaaagacatttccggatgcggcaaaggacccgaatggaattccgaaagaggtatgggacggcgtgaaaagcggcctttccctggttgccagttatgccagatggcaggtggcacgggcgaatgagcaggccgccaaggcagaacacaatgcttctgccatcaagcagaaccagaaaaatacggagcggtccactggcagcatgaagtctgccggtgcggacaacaagaacaaggacccgttcctggatggctgggattcctgatttcaggggccttctcgcatctggtgaaaagaaagagagggccacatggcagttaattacacagtcaaatacgcagacaaaatcgcagagagatttcacaaggcatccatcacggactccgccgcgggccacgaatattcctttgtaggagccaagaccatccgtgtctactccgtggatactgtgccggagaccgattataaccggactgcagatggcaaccggtttggcaccccgaagaacctgggcgacacgatccaggagatgacgatgaacaaggcgcctgcctttacatttgtcattgagcctctggataacagcgatcaggccatcgagaagtcagcgggaaagtccctgcggcgtcagctggacgaggtcactatccccaacatggataagtaccggctgagaaagtggtgtgagggcgccaacatccagtatcagccctccgcagcgcctaccaagagcaccattgtggagtacatcatcgatgtcaacgcccagatgacggacgcctttgtcccggtggagaaccggacactgtatatccccacggagtattacaagctgctgaagcagaacccggacttcatcaatctggagggcctgggcaccaaggcgctggcaaaaggcgttgtgggtgaagtggacggaacgaaagtcgtcaccattcccaagagctatctgccctccggcgtgtacttcctaatcaagtacaagggatccagtgtggaccccgtaaagctgcagcagtatgacgtgctgcccaaggtacagggctatgccggtcctgtggtgcagggcgtcacctactacgacagcttcatcctggcaaccaagggcgacggcgttgcagtgtgcggcagtaacgcggctgttctgtcggctcccacactgtccatctctgcgcacaaagtcacgatttccgaaccgggcagcaatgtgtacaagtacacggtggacgggaccaacccccggtacagctctactgctgagacctatccctccagcggcgtgacgctgacttccggccaagttatgcggtgcatccagatcaaggacggctgctgcggcatggaagccgacaaggcatacgagtaagcaatataggcccccgcaaggggcctattcccctagtcattccctgaaaggtgagcgcatggcaaacaagaaagcacgaaacaacagcggagccgtcaatctggctctgggagatttgaacccaaagcagaagcagttctgtcaggcgcggtctcgctatgttggatacggcggcgcccgcggcggcggaaagagccatgttgtgcggattaaagcgattggcggtgcgatgacctatccgggaatccggattttgattgtccgaaaagaatatccggaactggagcagacgatgatcctgcccatgcggaagctgattccggcagagatcgcagcatataacgccaccatgcacatgtttttcttctccaacggaagtgttatcaagttcggacattatagcagcggggacgatgtggaatatcagggccaggaatacgactggattttcatggacgaggcgacacaattcacggaataccagttccgaacactgggcgcctgtctgcgcggtgctacgaagtttccacgccggatgtacctgacctgtaaccccggcggagttgggcacatgtgggtcaaacgcctgtttatctctcgccagtatcagaacggagaaaaagcagaggactataccttcattcacgccacggtggatgataatccccagctgctggaggcgtccccagagtatgtgcagatgctggacttgctgccggatgatgtgcgcgcggcctggcggtatggcgattgggacgctctggccggaacattcttcccggagttccgggcggagactcatattatcaaaccgttctggaggattcctgcggagtggaagaagtaccgggcgttcgactatggcctggatatgtttgcctgcctctggattgctgttgatttcgatgggcgctgctatgtgtatcgcgaggtacagaagagcggcatcattgtatccgaggcggcaaagctgatgctggacctgacgccgtcttgggagcagatcgagtttacggcggcgccgccggatatgtggaaccggcagaaggacagcggaaagagcatggcagagctgttcatggaaaatggcgttggcatcattcgggccagcaacaaccgtgtgcagggctggatggcagtcaaggagatgctgaaaccactgaacagcgaaaaggaccggccgggcctgctggtgacgcaggactgcaaggggctttgcacgaatcttccggccatccagcacgacgacaaaaacccgtcggactgtgccacggaaccccatgagatcacccacatctgcgatgcctgccgttatttttgtgttacccggacactgagcgcggagaagcccgcaccgccgaaagtggaggacttcgatagcgccgggatgacggactacgacgacgagatgaccggcggagaaatgacagacgattatctgacctatggagggggtgactgacctgtggcaagcatttccacatcgaacaatctaaccattctgaaaatcaaggagtttctggggttgaacgaaaaccaggacggcgacaccaaaatcagagttggagagctctctgagatgcggaactttgccattaccagggacggccatctccaaatccgtccaggtacgcagacggttcttgcccttcgctctgcctgggatagctgggcggacagccaggaagaaggcgtggaagagcacccggtattctgcggctgctggtatggcatggtgggaggggaataccatctgctgtgcgcatttggcggtgtgatcttcgatgtggacattctgctggagagtgtaaaggcagtagggacctgtacccaggacaagacctcctttttcggctttgacgagaaggtttatctgctgaacggccatgagtacaagagctggactggagaatcagaggagacctttcaggatgtggaaggctatatcccgctggtacagacagcaaccacgccggagggcagcggaacacagctggagaatgtgaaccggctgacggggctgcggcgtgtacgcttctccccggacggcgaggcgaaagattttttcctgccggagaaagagatcgacagtgtgaccgcggtagaggggacggatgtgcagtataccgccgacaccgcggctggaaaagtgaccttcaacacagccccggccaaggggacgaatactgtgaccatcacctacaagaaaggcgatggcgcccgtggcgatgtgactgggatgcacttctctgagctctacaacggctccaacgatacccgtgtgttcctgtatggagatgggacaaaccggaccatctacagcggaatcaacggagacaccggcctcgcgtcggcggattatttcccggacctatacgaggcggccatcggggacagcaacacgccgctgaccgctcttgtgcggcattatgcccggctgctggccttcaagcgggacagcgcatggtcgatcacctacagcaccgtgacgctggacaccggaatcaccacgcccggattttatgtgctgccggtcaaccggcagatcgggaatgacgctcccggacaggtgcggttactggaaaacaatccgctgacactggacggcagcagcatctaccagtggcggtctacgtccagtaccgggaatatcacggacaatgagcagaatgcacggcgcatttcagaccggatcgcggccacgatcagcggttgggcgctttcggaggtcagaaccttcaacagaaagcgggagcacgaatactggtttttgtggaatggaaacgccgtcattctgaactacgcaaatgacagctggtattactacaccaatatgccgttccagcagatggtggatgtggaggatgacacctacggcatcacggaggatggaaaaatcaagcatctgtcccggcagtatcgaaatgatgatacagaagagatcgatgcctatgccgccacaggctccatggactttgacaaggactggctgctgaaatactcccctatgctgttcgttgcaatccagccggaaaccaacgcccggatcacagtgacggcacagagtaaccggaggagtgattacccggagaaggttgtggcatccagcttggcgacctttacccatgcggatttccgccattggtccttccgaaccaaccggaaaccccaagtggaccggttgaagctgaaggtgaagaaggcgactttctacaagctgattttcaagagcaagagcgcatccgcgacggcgactgttctggagacggacattcaactgcggtatgccgggaacgtgaagtaaggagttgagcaatgaagaagtttgatccgacacctcagaaggtgtctgcggagtatcaggctggggtccagtttaatcagggaattcagctgtatgactgcgtgaatgtcaatgagaactttttcattggcaagcagtgggagggagtacatagcaatggcctgcctactcctgttttcaatttcctgaaacgtgtcgttttgttttccgtggcgaatgtgtctacagacaacctgaagctccacgcaaaaccgctgccctccaacggaaaactgacaggtcaggatgcagagattttgacagacctcttgaatgaccaattccagtctattttcgagttcaacaaaatgggggcctgtatccgcgagtttgccaggaacgccgcggtggatggggacggctgcttgtacacctattgggaccctgatgtagagacagggcagccaagcaagggcgcaatcaaaacggaagttttgatgaacacacaggtgctgtttggaaaccccaacagccgagacgttcagagtcagccctatatcatgattgaacgccggatgctggtttctgaggccaagaagcgggcaatcgcaaacggcgtcagggaggatgatgcggacagcatcactgctgacagcaagcagagcggggatagccgcatggacgagctgggcggaaataaagttacggttctgctgcggctgtggcgggatgacgagagcggaaccatccatggttatgaatgcacgcagaatcaagagatcaagcccgaatgggaccttggaatcaagctgtatcccatctcctggatgtcctgggactttgtacaggactgctaccatgggcaggccatgattacagggctcattccgaaccagattttcgtaaacaaactgtttgccatgtccatgatctctctgatgatgctggcatatcccaagatcatcttcgacaagacgaaggtcgccaagtggagcaaccgggtgggcgcggccatcgccgtcaacggcagcgtggagaatgtggcgaaaatcatcgacccggccaccatctctccgcagatcagccaattcattgacttggcaatctcctacacccagcggtttctgggcgcttccgacgtggcccttggcgatacacggcccgacaacacctccgctatcattgccctgcagcgggcggcggcgactcctatggagctgacaaagcaaacgctgctgcaggccattgaagaccagggcaggatttacatggagtttatgggcgagtattacggggaccgctacgtggagattcctgttgaccagacagctctaggtggcaaccgtgtgatgttcaccatgccggggtctaatgggaaggtcttagctccgttcgatttttccagcctgaaggactactactttaccgtggacctggatgtgggagcatcctcttactggtccgaaatcgcctctatgcagacgctggacaatttgctgatgcagggcaagatttccacagtggagtatttgaagcgcctgcctgccggtcagatcacagaccgggagacgttgattgcggtattacaggcagaccagcagcggcagatggcaatggcgatgggcggcgcaggcggcaactccgggaatgggggaggccccgcgcctgccgggcaggaaaatccaccgctgcggggcggcgccggatatggggcgttgcagcgggttatcaaccagacgggagaagttccgcaggaaaggggggcctgatacatggctctgtcgaaatttgagaaggacatggcgatcatctccgctctggacgatgaaccgaacgacgtgggcggcctgacggctgcggagctgaaaggcaaatttgacgagggcggtcaggccatcaaacagtttttgaatgagacgctgacaccgcagattgactccgaaaaggctggccgtgatgaattggaagggcttgtcctggggcagattccggatagaacaatcaccgttgaaaagatggccccatcgttctttacgtccattctgacccctcaaatccaagtaacctacaacggaggtgtttaaatggcacagcagttaggacaggtggccgtcggcacactggtaaagctcaatgagaatggttccccggtggaattctatgtggcgaagcatgattatgagagcggtttaaacggagccgggcggacgctgttagtgcggaaggaatgctatgataatcgggtgtggaataacattcaggtaaatacatacgcctctagcgcacttgatagctggctcaacagcgattacaagaatcttctggactctgattttctgacggtaattgggaccacaaaatttcaatataccattggttacggagataaaacattaagcacgttagaacgagcgatttttcaactttccagaacagagcttggatttacgctcccggctgatgcaaattttgagggaaatattcttcctatcgcatcgattttgcaaaaagcttttttgaacggggaaacgaattcgcaatggactcgaacaccaaatacatcttatctcacatctgccttttttgtatatgcaggtggaagttctgattcgactggcgttactgcagaagctggcagccgccccgcttttaccgtcccttccacattgagcgtaactgacgatgggacactctctctggcgtctgctcctccacatgcgataactgtccctgttcaagctatgcagggcaaacagcttgcagtctcctggcctgctgtggacggcgctgacggctacattctggagcgcaaagcaaacacggacgctgactgggtgcaggtgtattctggagccgatttgactttttctgaaactgccgggacctgggaatcggttcagtatcgggtaaagtctggcgccaatggaaaatatggcgaatatacaatcagttcccttgttgatgtagttcctgtttccgttctggtaatttccgggtccgacggcagcttgggcactctcacaaatgatgtgcagtattcggtgtcctccagcggaaccagtgctttgacggttacggaatctgctggacgaactacccgaacgttcacggcaacaaacggtgccaccatcaaaatccccgtgatggacctgccgaccggcagcggcacgatcaagatcacggcatccaccaatcccggaagcggcgtggtaacggtgacgagatcgtggacgtataccaagacggcgccgacgtttgccaataccggcagcacggctcaactgcaacagaatgggaagaacattttcccgctgacactgctggagtgtgtgcgtgggacagaaagtctggctcctggcgggtttggctttggggatgcggtgcagagcattgaaactaccagcgcaggagaatcctatgagacatactgcgccaaggtagacgccgtactggacgggatgcctgacaagaccgcaaaactggtgctggcctatccgcctgcggtgtacggcaaagcgggtactacgatatcgctcttatataagggcgacgccaactatgcagtgctatccaatatcggcagtgcagacacggggctgtgcggatggcggatgataaaattaaaaaaatcatcgtcagacccgtctgcttggcagccgtttgagtgggagcatccccccatgcagttgggcgtcgagtaccgcaccgtggagcggtacaacggcaagccgatacacatcaaggcggtgagtctcgggctgctagaaaataatacttctaaaagtgtggagcatggtatatctgattttgagtcatgcgttgaatgcagcggatttagtggacctataaatcttgtcgggagcggtggtgttgattcaatatatgcaacaacttctcgtgtcgggattgatacaaatggaagttttagtagtgcagcaacatcatctaaattaaatactgttgcgattatcaagtacaccaaaaccacggattaaggagggcaccatgaagatcatcaaatatcagttggcaacagagatcaaccacggcacccctgaggaaccggacatcgagacggtgttaactgctgttgttgtgtcctatacagaggaggcttacgccatcgcccaggcggaggcataccaagggcagattaccgtggaggacgatggacagccggagccggaaccgggagccgaggacattactcttgatatgctggcagaccatgaggaacgcctgtgtatgttggaactcaccacaaccactgtatgacaggaaaggagcaggaccatgacaactgtatacaatctttgcaagctgctgattgaccggggccgcactgacggccttcaggagaagatggacgtgtatctcgccgccgacaggctgaccccggaggaatacagcgccctcagtaagatgctgactgcggaggcggcagagtaaaatggacgagaagtgcatcctggacccgcaaagggattgcctgggcctccagaaagccaacatgctggaaaagcagatgtcggaatggcgggaggcgtcccgcaacacccacaaagaactctttaaccggatgcgggaactggaaaaggcggaggccgcccggaatgagcagtacgacaatatcatggagaagctggaccggctgatctcatggcaggaggccgagcaggccaagccgaaaaagcggtgggaggccatcgtggacaagtccgtgtgggcggttctggcggctgtgattgcgtttgttttggcccgcattgggctgtaaaaaagcgacgcccccgaaggagcgccgcgagtgccccgatatggaaaaaagtaaaaccacatcaataaggaggggggcacacctgcatcttacatcatcatcaaccggcggtcaagccggaaatttgaaaggagctaccaatcatgaacaagaccatcaataacatcatcgatgacttcaagagcggcaagattactgtggaggatgccaacaagctgctggttgaggctggcgccggattctccctgaaccccgaaaagaaccccgatggcggatggaccgaggcagagatggcggagggattccttcccggcgaggaaaaggagcctcttccggacaaggtagacatgggccgaaatcaggcgcttgccggacaagtggttcgccagaataccaagcgcggaaagtttgatgtgacctatgatgcagacggttatgccgtcaaggccatccgagtgtaatcgggaggtctgatatggacatttcctctcttggcatcaccggagtggcggctatcaccgtcatctgcctgctgattgggcagggcgtgaaagcgtcctctctggacagcaagttcatccctatcatttgcggtgtctgcggtgctgtgctgggtgtggtaggtatgttccttatgccggacttcccggccacggactacatcactgcggcggctgtgggcattgtgagcggtctggctgctaccggagccaaccaggtaatcaagcagctgggaagtgacagtaaatgagctacacgataaaggagcagctggcgaactccgggaactatggcggttcccggaatgccagccaaatccggtatctggtgtaccactacaccgggaatgacggggacaaggcggcaaacaacgccgcgtacttccagcggaacatcgtcaaggccagtgcccattactttgtggacgataccaccgtatatctgtccgtccccgatctgaagattgcgtggtccgtcggcggcagcaagtacgccaacgccgacaagactggcggcggcaccatgtacggcgtcatcaccaataccaactctatcagcattgagatgtgtgacaccatccggaacggtgtctatcaggccagcgaggcaacccttgccaacgctgccgctctgggccgggagctgatggagaagtatcacatccccattgagaacgtgtaccgtcactttgacgtgactgggaagcactgcccgtcgtacttggtgaacgcccagaagtgggcagagttcaagaagagactggaggtcaagatcatggacaatacacccagcggcgcccacaaggagggcgtggaatgggccgtaaagaacggcatcctgacgggcaacagcgagggagacctgatgctctcccagcccgttacccggcagcagatgtgcacgatgttgcatcggctttgggagctgatcgaaaggacgtgaaactgtggcaactgcccgtgtcagattaccggatagcctggatggccttatgcgctccgagatggagacggccatccgggaagctaatcttgggaacgacgatacggacattgcccggcgctacctgatcgaccaagtcccgcagatcgacattgcagcggagttcggctgggagcggtcaaccatctcttatcgactcaaacggattctccgcaaagttgaaagcacagctcaaaaactacatttcacataatttcacctaaaccccgcttgggaaccacccaggcgggggctttttttgcgaaaatatcatcaggaggacgtaaggaacaagggctggtacacgtcgccgccctccttgcggcctcctgatttcaatgataaggacgtgttttaagttgattctgaatggttcagaactggtggcccggttggtggcctgtggcttcacggagtccacagcaagagacacctgcgagaagtatgcggcggagggagatttctccggattggaacggtttatccggcagaatgagcttttgtatgacgaccgaaagcaatatgtttgaattttacaatccgaacccctacgagaaaaatgtgggggattgcaccgtccgggccatctcgaaggcgctggagcaggactggtacaggacatatcttggcctctgcattgagggcgctgtgaggggtgatatgccaagcgccaacgccacatggggcgcttacctccggcggcatggcttccggcgggacatggcgcccgaggatatgaccgtggcggagtttgcgatggggcatccaaacgggacttacattctggccctgtccggccatgtggtatgcctgcaggatggtgtgatctacgatacatggcacagtgaacacgaaactgtgctgtactactggcagaaaggatgacgtgagatgccgaactatccctattactatcagccgtaccaaccgtatcagccgcctatggcggaccagctgacgcagctgcggcagtcctatcaacccatgcagcagccgcagcaagccccggcatctccgtctattgtgtgggtgcagagcgagatggaggcggcaaattatctggtggcgcctaactctgccgttaccttgtgggacagtaacgccccagtggtctatctcaaacaggcggacgcaagcggcaagcccagcatgaagatatatgaccttgtagagcgcaatcagaggcccgtacaggccccgcaggctccaacggtagagtatgcgcccctgtcccgcttggaagcgttggaggcccgcctggatgcgctggcggcaaaagataaggaggatgcagaatgaacccgttttatcaggctatgggcggcaacagacagcccaacatgatgcagcagtttcaatccttcatgcagcagatgcggggcaaagaccccaacgccatgatacaagagatggtatcctctggacgcatttcccaagatcagctcaaccaagtccaaaagcaggcccagcagatgcagggcatgtttgaggggatgcggggtatgtttgggaaataaacagcaggggcattaagcccccgccgttcggtcaggttttgtgtggactggctctgtcatcattctctcaatgctccagccacgcacatatcggttgtgaaatgtgacccagttaattcctaattcttttgcccattccacaagcgtttgagtccgtccattgtactcaatcacaatgttatcggacttgtttatattctgcgttttcatcgttgcccagcggcagttctcaggacaataggggccgtcattatcccttctgtccagcgtataaccctccggcctaccgccaatagaatcagaccactcaacaaacttgaaaaaatcatgccattcttcgcaaacataaatcccacggccaccataacggcgatagatttttgacttctcattgtaacaccgttgcatcatctgtcgccagattccatacaagggatgcttactgcggccgtcttgtttggtgtagatggtatttctgagacaaccgcaactttttacggctccgtttttgaattgataaggcaatacatcaattgtcccaccgcaatcacatcggcatcgcaacctccaactggtatcgtctggctttctttcagccagtccaattacagtcaagtaattgctccgttttccgatgtactcgttcacatcgaaatatggtttatagattcttttttgttccatcgcatttaccctttcatgcgccctgattgtcagattgcgtggaaaccgtcagggtaacggcttgtcgggagcgaccctatccacgcataacaattatagcacaaaaacatcaaaaagtatatagatgcggccgcatttataaatatttttacaaaggagaaagttatatgtctcttagtaatgacgcaactctgactatgccggtagctcctgcgtattccgctggtggctatggcggcaatggttccatgtggggtggagactggtctgcctggattattttgtttctcatttggggggcctttggaggcggctggggtaatggcttcggcggaggttttggcggagcaaacgggcctggattccagggttacgctacacgctccgacatcaacgagggcttcgccctgaacggtctccagaacggccagacctccatccgggatgccgtgagcaacggcttccatggcgtggataccgctgtgtgcaacctgggctatcagacgcaggcgggctttaacgccctcggcgcccagctggcgcagtgctgctgcgatactcagcggagcattgacggtgtccgctatgacatggctacccaggcttgcgatacccgcaacaccatccagtccagcacccgcgacatcatcgacaacgccaatgccaacagccgcgcgatcctggacttcctgacccaggacaagatcgctactctgacggctgaaaaccagagcctgaagttccaggcttctcaggcggcgcagaatgcttttattaccgctaaccaggaagcgcagactgccgagctgatccgccgcatcaatcccatgcctgtcccggcctatcaggtgcccaatccttatgccggatgcggctgcaatccctgtggctgcggctgctaaaacccaatacatcaacttgtaagaaaggcttacatgttcggccccgtgccgattttgaaccatgcggcggggcaacagcctcgccgctatctttttgaaaggaatgaagtttatggctgaatacagcaacagcgcaatcgtaaccgttgccgctggtcagaacgtgccttttaccgaggaggccaacacgggcaagccctgcattgtgcatcgggaaggcgctgggctggtgactcttcgcgggcttacgaaccagtgccgcgcgaaattcaaagtctcctttggagcgaatattgctatccccaccggtgggaccgtggaggccatcacggcagcgatctccatcaatggtgaggcgctgaacgcttccaccgctaccatcaccccggctgccgcagaggatttcttcaatatttatgtttccgctgtggtagatgtccctcgcggctgctgcgtcactgtcgccgcaaagaacaccagcacacagcccatcctcgttgccaacagtaattttattgttgagcgcatcgcgtgaaaggagaaccgatatggaatatctgtatgacctgaaagaaaagctctgcaaggagctggaggaatatgcccagaaaagcaacatgaacgccggggacctggagatggtccacaagctgacggataccatcaagaacgtggacaagatcatgatgctagaggagggcggttacagtcaggcagccgacatggactctccttccagctatgccagaggctccagctatgccaaccgtggcaagcactatgtccggggccactacagccgggacggcggctactcccgtgacgggcgcggcggatacagccgcgacggctactcccgtgcccgcggttattcccgcagtgaggcgaaggactccatgatggagcagctgggcgctatgatggaggatgcatccaatgaccgggagcgggaagcgatccggatgtgcatggagcatctcaatcaggaataattcccacaaaacaagggggccgcttgcatagcggccccttttgttgtataattgttgtacaacttgataacaagctagagcgttcagcgccagagttcggagtgatccgggctttggcgcttattttttttgaaattgaggtgaaattgatatggcagctgcagaggagtctatccgcgggaaaaccagaccggatatgtccagaaacgagggactggctgggcagacggtcacgaagggagactatgaatatacctacgatgataatgggtatgcgaaaaaggccatcaatgtcaaaaacagacaggaacgggaacaggaggggtatggtggaggcggatattccggaggcggagactcttcctattatgactctctccagcccacggacctttctggatacctgaatgacatgtacaaagcctacacggacgcacagctggcggctctgaaatcggcatacgaacagaatttggcaggtctgcaagcagacgcggagaaaattcccggcatttaccagggcgcccggaatgaagcggcatctcagaatgatattgcccgaatggcctttaatgagtacgcaaacgcacgaggcttgaacaccggaaccagcgggcaggcggctcttgcaaactccgctgtgctgcaaagcaacctcacggacatctccacaaaggagtccgatgccattgcggaaaacgccctgcaacagcagcagctggcgattgaataccgcaacgcggcagtgcaggcgcaggcggaagggaactaccagatggcccaggccctgtacaatgagtatgtgcggcaggacaacgccgccatgcagacggcacagcttgcccaggagcaggccaactgggaagcgcagttcaacgctggaaacagccagtggcagcagcagtttgacgcttcccagcaggagtatcaggacagcctttcggcacagaaccgggaatatgcctataatctggcgatgacgatgctggcggcgggcgtgatgccggacaccaatacgctgaacgaggctgggatttccacagccgacgcgctgaatatgcggcttgctgcaatgtctactggcggttcggacggcgggcggagaagtacaaacacttctggtggggattctagtggcggcgatgaaggaaacaaaatcgagagcaccccagatacagaaggcactgtgaaaaaggcagaccgtgacaccacaattcgaaatctgaatggacgtctgcaaattacagacgcctcccaacttggcccagccgcaatgaatattgcaaacgccatgagcaggtcaaactcggcatcacagctgggaactattggtgaaatgatttcgaatgcacttgaacgtggacagattacagaggcagaagcggactttctgcttcggtctatcggcctttaacggaggtgtctatggcaagcatccaagaccggcttaacaagttgcaagaaatgagccgccagcaggtgagagacagggagcaggaaacgaacccaaggacaaaggcaactaagaaaagcgcccctgtctctcagaaactgcaaccaactatacaacccccaaaaacaactgatccacggcaggaccacatcaccgacattgtggacagcaccacgggcaccgtgatccaggtggaccggccctcccgtctggggagcatggctaaaggcgcggtgcagggaaccggtgcaaactatgcctcttccggcgggtctttgctggacctgatgcgcagtgtggacaccgccaacagcttttccacaaagcgggccaatcaggaggctgagaacgcagcccactaccgggagatgttgaaacgtgggacgttggatgatggaacacccatcacggcgtctatgcggaaacagctggagaccttggcggcgcgtgcggagcagcggtccggcgtctaccgccagggagcggaggcccagcacgcccccatttcccgtgccatcaactccgcctatgagacagcggaccgcctatctgagcagtctgcggagaatatcgcggcggcgaaagaggggcttggcggtctggggcagtttgccgtggacgtaggtgtggccgggacgcagctggcaggggacgccttgatcggcgccctcctggctcctgtcaccggcggcgcatcggcccttgcccccatggctgtccgtggctttggctccgggacgcagcaggcccggcaggagggggcgacgctggggcaacagctggcctatggcgcggggagcgcggcactcagtgtagcgacagagaagatcgccaacgtggccgctccgcttcgacggacctttggttccggtgttctggacaatgctatcgcaaaagcaaccggacgcctgggccagagtgcggctggacaaacggtcctttccgcattgagcgaaggtggcgaggaagtcgtggaagcactggtgcagcctgttttgcaacagatcacctatgataaaaacgccctgcagcaatatcaggacccggactatctggcagacaccatttatcaaggcctgattggaggcgctttgggtggtgcgcttggagctgctggaagcattggccgcaggagcgccgaaaatgccaatcgccgggccacagatgccgcaggaacggcgcaaacggaaactgcacccgtttccaccacccaggcacaggaggctgcagagggcactacaggctttttggagccaacgcttgttagccgtgtacgtcagtctattccgcatatccaaaacatgaatccggttgccgaggttactgggacagaaatcccccgaagtggaaaactggtggatcggcttgcctcttttgtcaatgcgattgggaataaggtcaatcggcccggctttggtgatgttctattctccagggggagaatcaagtccagcatgatcggacatgggacaggcccttccaaaatcgagacatttgcggccgtcccggatgtaatccgaaacggccagcagattgactatcaacagaactggaaagggctcggctatgatacctacactttcgcagcgccaattacctaccgggggcagcctacttacttaggtgtcattgtcacgaaggacagcgccagcaaccgctactatcttcacgaggtagtggatgcaaatggagacgtcatctttagaaatgacgaatcccccgcatctacaccagacggaacttctgccctttcgggtgacctcgataccgtagtagacgcgggggatggtgcaggaacaacaccgggcactgtcgacaccgtgacagacgggcgggcctcccgaggagttcctgcttctaatactactatagcacccggcgcggaaaatgtcaattcggacgctctggcgcaaattctgtttggggatacccggcaggaaaccggagacacacaggcaccgccaacctatgacaacctgggcagcgcccggcggggcttcaccacccccggcatggaagggcaggagaggaccagccgccttgcggagtccatgccgtataatcaatatcaagaagccgccaccggcctttcacgggaggactatgccaagctgttccggtatgaaagccaaacagaagggcgttctctcaatctggcagaagaactggtgtacgccgttcgggacggccagcggaccttcctgcgagacattgacgagacggcttttcatgagttggtgcagtccctagatgatgcgacggcatggaatgcgccccagatggatgccgcccggatgatccagcaggagctgcagggcaggtccgcaaatctggagatcccctctgaggaatatacggacttcctgcggatcatgcgggagcatgagactgccactggtcagggcgttcaggcaaacgccaagtggagccgccgggacaaccagaacggacaatcttcggagctggaggcgtgggacaatctgcaaaactccaatctttccgaagaagagaagcgcagcaccttccaacggattgtgaagtgggatacggagatcgagcaggccgcagagccgcagcagttgaaagacattatcctgaacgttgcacagcagcggggcgttttgaatggcttaactggtcggcagagccggattatgaccgcggttgcaaacagcagcttggactccctgacattcgaccagttgaagcagttcgcctatgcttccacttctgcgctcagcaccgactccacaccggccaacatgggtcagaagatcaagactatccaaatcctgaacatgctgtccaaccccaaaacggcggtgaagaacatcaccggaaacacgtctttctacggcctggacgcgctttccatgaagggggcggccctgctggatatggcgctgtccaaagtaacagggacccgcagcgtggcctatgaacgttccaatctggggcaggcagccaaggcgatgcaaatggcgattgcagaaatcaccatggacgtagacatgggcggtaatcagagccggtacggcaccagcagccgccggaccttcaaagccagcggaaactttgtggaccgtgtaatgtctatgctggagcggaaccaagcgtaccttttgaatgccacagacgaattctacaagggccttgcccgcagcaatgcgagccgtacccaggcgctggtcgaccaagggaagatcaagactactgacaaggactatgcacagaaccaagctgacgcacttgcacgataccggacgttccaggatgacagcaaactttctcttgcgatccagcaggtacatgatgtactgaatatggttgctggcattggtgacagtggacggagcatccgcggccgtacagtccatgccttcggagctggtgacattgtggcgccgtttactcgggtagccggaaatctggcatctcgcggtttggagtattctcccgcgaacgctgtcaagggtattgtggagatgggtaaaaccgtggcgcaggctgtcagcggtcagaatgtggacccggctgcacaggcccgggccgtctctgacactacccggggcctcaccggaaccgccattgcttacggatttatgcttttggcccagtcggggcttctgtctcaggcaggggacgaggatgatccggacgtggcggcgctgaattccagcgagggcatcacgggaacccaactgaatatctccgcaacggaacgggctttgtccggtggaagcacggaatggcagagtggagacaccctgatcgacctgtcctccatcgagccgctgaacctgttgatgaacctgggaacggagatggcaaagagtgaagggaaccccatcgtttcttcttttaatgctgtgccgaaatcctttatggatgcaactgcggagcttccggtgatgcagttcattgggaatgcggcaacggacatcatcaaatatggacaggacccacaggaagtattactgcaggagggggcaaacacggtagcttcttccctgataccaaacattctgcggtctacggcccgtgggctggatgaccgaccccgcaatacctattccggggatacgctcggagagcaggttgtggacagcgtgaagaacagcatcccgggtttgcgagaaaccctgccggggtctgtcaacccactggggaggaaaagctgtatcaggggagcactgcggaccgcctgctgaacgcgctgctgaacccggtgggagtcaatacctacgaccagagcgaagtgtctcaaaacatggaagcgctgcgcgagcggacgggggagacctccttctatccttctaagagcgccccatcggagctctcgtacacaaaagatggcaatacctatagcaagtccttgacctacgaggagcggcaggactatctccgggatcgcggcgccgtcgcactgactacgctgtcctccatgatgggcagcagcgcatacaagagggcgaatgatactaccaagacggagcttttggacctctgtaatgactacgccagccaacgggcaaagaaaacgattctgggagccgacagtgttccggcatgggtaaacaacgcagagacagcgcagaacgatcttggaatatctccagcggaatacttggccctctatcatcagtacggcgccgagatcatgtctgggacggcttatgagaaaacgaagcaggcagtggctgccggtctgactgtcgaacagtatgcggatatgaagaacggaattgatgcggacaagaatgggtacaaatccaaaagtgaggccagggcttatctggatagccacaatttcacccaagagcaaaaggcggacctctggacaatcatcaacaagagttgggagaaaaataacccctacgcataagagaagccccgccagacggcggggccttttctcactgtttggagatgatcgttttcagaaccggaacaacgctttcgtagtatcggaaggacgggacttcctttccggggcagttcttggcaacgtcattgacccatgtcccgtactgcttcgttttcaggtggttccggttggcgagcatcccgaccttgtttgcggagatgcccagtttttcgccgatctcctgtgctgagtacatcttttccccgatatagggcagggggagcaggtattccccagtcagctccttggtagcgtgggcctggagaacctgtctgtaagtaccgtcatactccttcgccagacgctccaaaagctgggccttgcggacgcggatgctctccatctggtagtcggtcattcccagccgctttgttttgccgccttggatatgttcccgcatcttctcaaaggcggagacgtaggcagcagtgaacaggacgcccttttctccggtcatcttgttcgccaccatgtcgcagcccttcttggtcaacaggtagcagggatattgtttgccgcgactttcaaatgtgctctcgatgaaaaaatctgacggcgcaattttgcgctgcgaaatttcatcggatttttccatcacttcaatgtatccacggatatcccggagcaaatccttatggttccggtccgtccattcagccacatcccggctgtcgaccacttctgcgtcattgaaattaaaaactctcagttcgttcattactggccctccttcatgccatcctctacgccgagcaggtaaatccgatatacggttgctttcattgtatctgcaaagatttcatctttgcattttccgggagcagtgacggacttccttgcaccatcccatattctcatatactcttctagaacttcatccagggaacgtcctttcgagattgcgtccagtgggacacctttctgttcattcattgtgatacctccatagatttttgaacttgttcatgcagttgctctagagagccgcagatggcgttcagggcagggaagtaaatgctgcggacacgcttggaaaacatttcgttcagcacctccgggttgaacccgtccaggttttcatgccgctctgggtcagagtcaaattcatcctgatcggcagcttccatcgtgatctgaaatatggcgcaaatctgtttcagcctcacggcgacagtgtccatctccatatccatatcagtcaccctccttcggctctttggtggtaatgatgatgttgtccggggtggtgccgacataggcggcggccaccgcaaggaccagataccgggtgttggatgcctgattgattaactcctgaatcgtcgcagttttgtccatgataatcctccgttcaatttcttcttgacgggaggtctccatgaaggtagaatggatttaccggcagggagacctccgggcggagaaaacagctcgtaactttccacggtgccgggctgttttcacttttttgtggctaaaagtagatggattccttgccgtatggcttcaccacgagaaatattgtgcttctcgcaatattctctgagggctttttcggttcccgggtctaacctgattgtcaggtttacacccttcggattatctactttcggccttcctgttctaggcgacatttcatcacctcactttttgccttgcatttaatataatttatgaaaggcgaaaagtcaaggagaaaattcacagtatatcatggacagattgtggctctaagagaaaaaataattttctgttaagtcttgctaaatcctgtcaatcggtgtatgctttgggcgagggaggaatgaaagatgtttatgtcttttttgttggacatcgtttacgctgtcacatacaacctgattctgattgtgtttgggttgattgcggtttcaaaagcgaaaaaagggaagaagtcaaaaggctggctgattgcaggtgccattattcaaggcgtgtcagttgccggtgggattttgggaaatttggggtttgggaatgcacagccgataacatcctacggcatcctttcttacattttgtatgttgtgctgattatcgcttttgcgcttctgattcgaaagaagaaaactgtatgagagacctcggcggggcgggtgccccgcctttctcattcctcccggtattcgatgtacttcttgaatggggcggattttgctgtgccggaccgggccttgacgatacttccagaagcccactcgccattatccagccgcttggctttgaaaaggatttctctcattgggcacctccgatgatctcgtcaaaggtatatacctgacccttttcaacagacgggaacagatgtctggtgattacttctctctgaaaatatgtgccgtctacaatttccaggcactgcgtccatgcaccatcgtattttattgcattgatctccgggagcaaaactttgattgccttcgccctctccacctcctgctcggtgaagcggggcttgcagatgatgcaatcagcgttattgataatgtaacaaagttctccggaggtcacttctccaccatgtgcatttctgatctctccatctgtaccgacaaaataacttttcggctcatcaaatgggaagtcattaaactggaagttctggtttacctcaacccccagcacctcgcaaattctcggtttgtccatgttggcctccaaactttcacctttgctatcattttttgtaagtacatttccatcttccaccacctcatagcccatcaggcgagcggcttcgtgagggttggctcttacgtattcatgacacggcctctttgtccctgcgtattgctgcacgggttcccgaatctcgcaatagtcgcaatcttctttgctatcgcaaaactgcgctaatgcctgttcaatggtaagtgcgacttcgcccgtcttactccgaaacttcatggtcggcctccttgcccatgcgggcaccacaatgacaatatggttcttcttttagctcctctcttccgcataagctacaacgaaatgatgtgtattcatggagaataggatccccattctggtcatattcaactggaatatatgtatgatggatttctggattccatctcccgtgtcgcaccggggcaacgtcagcggcggggatgcctttgattgctccgccaatattccaagccacggtatcgccgcaatagtctgccattctaagccgatcttcatattctttctggcagatgtcgagtgcttccgccctctcgatgtactccttcattctctccacctctgttcgtggtcgtctgcaatccgtttaatgatttccagctcttcatccgtcagcgtccggttccacgcaatggaaaaatcgcccgtacaccgattcgggcaggccgtacactcgcagcggttggcgttgctggtatcattcaccctgaatgggcagctgtggttatagcagtcagttctaatccctaattcccgttcgacaaattcagcgggatacatcggcggtatagttttattctccatcctgctcctccaatacggtcatatcatagccgctctctataaatcggatcgttttttgatggtcgcaagcgttcccgagataagtgtaaatctctcgcatatcctccacactgaacctagtgtcaagatattgatttataccattcaggaagaaaatatgaagggctgtattatctactgcacggcgaaacggcgtggacttacaagccgcgcgggaaaaccactccaacaccttgcactttacatccagttcgctcttgcaagtgctgatattgaaatacacatttgccttttggtgggcgataaactccccctgggcgttgatgaaccatccagggaaggaaagcccaagtctcctaatgactgcccaatcaaccatcctgctccctccgtagtgcggcctcctcgcgggtcaggaaaacggttttaccgctatattcggtgttgccaattttgagccgccatttcccgccgtcaaagtatgtcagccgcttcatgtcagtcctcctcatactccgggtgtacgcccatgcaacagtcaaagcaaatccagccagtgggagaacattcatctctcaccatctcgctctgctcataccgttccccacagataccgcactttcggtagtatttacgctttttcatgtcagccctcctcgccgtcccacttccatgcggggcaaagtttgtgcaggtcctctactgccgcatccctctcccgcttcatctgatctctctgattttctacaatttcaatacaccgcttcacctgttccagctcggcccgcagctgctcgttttcggcccggagcgtggagagggtggtggcgccatcaagtgcaacgcctcttttcaggtccttcccttcaaaatatccgtttagctgctcaatcagcttctcaatgtccatcaggtgtccacctccactggttgcttcatccacttcaatgcagcttgcctgcacccttcataaatcggaatgtttggataagcacagatgaaattgcatactccgcctttttcatgctcacaacacttacaaaagtcggctctgagaaaaatgtccgccagttcctcgtcgctcatggcccggattttatctgcgtttgtcatgtttcatcctctccctccggcgggcggcggtaaaacacccaatgcgggatttcctttacattgtaaatgctacctgcaggtgtgatgatatgcccatgctggcacagacaccagtacccgttcccgccctcgatgggtttgcaggcaacccacacaggctcgtccatctcccgcagttcctccagcgtcagcggctcgttcggcggggtgagggtgggcgtgaagtaatcacacccatccgtacagaaacagcttgcgttctgcgattctcggctcgcccacagcgcacataccttttcgtgcaggcacttcttgcaatcaaactcttccatctttcagcgcctcctcagtcgcaatcatctcgattaccggaacaacttcaaagtctctgtcccacgaagaacagccgcttctagcctgcgcctcagaacgatatgtcttgacggatacgtcttttatttcggatatgggacgaaaactaaaagcctttgctagaccgcaccagacctctgttctgtttttccgcatgaccacatagcgcttgcgctcaatccgcatcgttcaggacctccatccttttcatcaccatctccacttccatcttgatcccctccagcatctccatttcctccgcgctcagaatcggcgcgcgggtgttccaggccaggcgggcttcgtgttccgtcttataccatccgctgttcgtaaaacatttcatgcagatcacatttctgcggacatttggctgatagtaacgttcgttccgcacccttgcctgtcctctgcacataggacatggcaccagcacccccgcatccgtcagccgcttcgcagcatctttatttccgagcatggctaatttgacgtcatccattacaaattcctccccattgttctgccattgcctgagctatgcctggaaaggtcttggcccgattcttctgtcggtctttcccacctcgcatgaaccatgttccagcttcgtgacagctgcatttcgggtcaacaatgttagttggctccaaaggaggaagtcctttcaaccacaggcgggtctttttctgaaccgggtgtccgaacatccacggctggacctcctgggtgtgcggcggcatttcataaatcttgctggatactgggttctccacacagatgtgcgggcagtcggcattcagaaacctcaagaaaaatgcttttgcctcaagccctgtccgatagcgctcctgattgagaacgccccccttgaacaggtgttttgctccggcgttcgacagatatgtacaaggcggaaacgccagaatcatgtcccactgcattttcagcatctccaacgcgtcacattggatgtgccactcaggatggcctccgctgcacggctcaatgtcgcagctgtatgcttcatgccccagcgccctgaatgctttgcacacttcctgagactcttcacaagccaccagcactctcatagcttcgccgcctctttgtcgcccagcagggcgcgcttttcatccgtcatagtcctaaatcctcccatgtgatctgccgttcttccaggtcaaacctggaccccatgtaaatgatgttgtcatctgtccggaaccgcccagggaaagcaacgttttccacgtgttggagctctaagagcttatcccatagctccctatggtgtgcccgcaaatgtcggaactcattgtcactggtatttgggcagaagaagcacccgccacgcttacagaactcataggctggagagaggagcccgtatttccggcagagttcgcgcgcatccttctgggtgtatccgtatttctgcagcagggatattttctgcccgcccaggcgcagcagtctttcgtcctcgtctgctgcatatccgatatactgtactgctcctttatgcgcccggcgaaaccggcccagcggaggtgtcttacagcgatcttgcaccttgcaaaaccccggcgacgggaatccttgatactttccggcccgcaacccctttttgatctggtgccaaaacacgtccataaacgtcttttgagatcgcagaacctccacgcgcacgccatgttcctcaaaccacgggattgctatcccgtggataaaatctgcatgttccgggacctctccgctggtatgcgcatcaaacatgacctcacagtataccaaggctgtcaaaggctccccgtgctcgagagcaagcagggctgttgccgtactgtctgcgccgccggaccatgatgcaaaatgctcagtcatgctctcttcctttccagcgggcggctctcatgcttccacctccgacggatagactgcgtactggcccttgccgtaacgctggtattgggacgccatccgccggaaggactggtattggatgcccagatattccgcacactctcgggcggtgccctcaaaggcgtattgcccgtccttgccgtagatggtgtacatcttcaggcagtagcgacgcggtatccgcacacgcccatatttccgggcccagatgctgacggtcgaaacggacacattgaccgctttggcaatgtccttctggaggcatccccggtccaccatctccagaatggtttgcagcttcttagttgtcatgacttgcctcccattcccggtacagggaaaaccagtcctccgcccgcatcgtcaccagccactcgcagcggctccgccggtgggctacaatgggatattcccaaggaggcgcatcgtgcttggcctgggccatggctgcctccaaatccagccgctccacacgcttgacttcctgatggatgccgggcagccctacaacgtcagaggcgtccccggtgttcccgcaatactgagccgtgcggcggcagtcatagccctgcccacggcaatagctggcccattccagctctccgcgcttgcctttttgtttgctgttcatggttcctccttgtggtgatacatttcccggatgtacttccacgtctcgtcgttcatgctttgggcagtaggtttttccttcccttcctgcttcctgcgcttttcccaggtgattacagcctgtttccagtccttcatgggagactgaccgatcttccagcccttggaggcgtagaaagcaacaaacgactctgggtctaccccgttgttccgctcctgacaatatgccctgacttcatcgactgtcggaggtgaaaagcgtttccccctggaagagggggtagggggagtataactatcgttctcattctcttcctctctctctacctcaccctctacctctatctctccctctatattgctttccgtttgcttccggtttgctttcggtttgcttccgcctcgcttcccgtttgctgcctttttgcttgctttgtcaagtatcggttttacaagcaaaaaggaagcggatgcctgtcctgttaatggcttgctttctccctcgaacacataagtacaaatcgccgtcacaaagggaagctggtccttcttcggaagcacttttaacgcctcccagaagctgcggtaaaaggtaaattggtcacgttccaagcagttcacccgccttaaaacggcagtttgccgtcctcttcgccgatctcggcgaagtctgcggctgagacattgacgccgccgctctggatggggaagtgggactccttttctgtgggccacacatagtccgctatcaggtctgtataggttttgccgttgtactcccggctctccagccgcccggcggcgatgacccggtcgcccttcaccataacggacagctggcgggccagatgcccccagcccttgacagtcaggaaagcggcggttccgtccttgcggccataggcccggacggagatggagccgacctccttgccgttgctggtgatgcggatatcgccgtcacaggtggcctttgcgatgacgagtccggtcttgacctcgttgccgctgcggtcatagtccgtaatgccattgataaacatcaggagtcctccttttgcagagcgtccaccagggcgtcgaagtcgccggacttgatcttgctggcgctgtcgtagccgtgggagcgcaggaagtccttggcctcctgtttggtaaatccgtggcggctggcgcaggtgtagaagaacttgacctgggcgggggtaatgggcttttccgggtctttgtccgcgaagtaggccccggcatcctctgtgtcgctctcaatgtcctgagtgaagctgtcggacatgcatcccagggacagggcggcggacaccagggcccgcttctgtgccatcttcagggcgctgttggcgccgtcgtagggggactggctgccggtgcggccctcccgggtgttggcggagccgtaggagctggtaatgatgtactctttgccatccacgatcttcaccaggtcacagcggacggcatagaagaagaatccagtctcctggttttcgatcttgctctccatgtggtatcgctggcagaggccgtaggctacagcaactttttcggcgcctgccttgaacagggtggggtgcttcgtcatggcctccccgttcttcttgcggatcacgccgaagtcgatgccacggcgtagggtctccggctggcagccaaacacggagatttcatagtccccggtatggggcttgcgctgcaccgtcaggggcgcggcgttatagctgtagagcattatttcttcactcatgcgtggttcttcctttccactgcctgattcatgaacagacagattttcagcagttccaggtcatagcggacttccgtgagctcataggtcccatccttggagagtttcagagcatagagataatccggggtactatgccatgggggcatcaattcttggtaggctgtcagctgggcccggagagatgggccgtggagttggccagtcttgatgtccaggatacagctgcggccatcatagagcgtcccgtatcggtccagcgttcctgcgtaaccaaattccagattccccatggggtgctcgatcagctcccagtccgggcggtagtctttcaggaagcggcggtaggctttcagatacccggcgatctccggcgtttcctccggtgtctcgccatagtcgatcagggcgcaggcttcatggacggcggtcccccggcgggcggcggtctccgccagccacggcttatccgatttgtagtcgtatgccagaaagcggcagatgtgggtaacgctggggagttccacgccgtccagggtataggtatgggacttttcatcaaactggatcaccggaactcgctcctttccttgatgctgcggccgtccagccactcgtccagctggtcctcttcctcttcccggagagtgtcggcgaagccccggaaacgggatagaagggagcggcggcaggatttgcagaggatgaccccagcgggcatatagtctttgcagatggggcagacggcggcgtcctcgatataggactggccgcagacgggacacagctcctcccggtagcggtagccggggaatacggtggggtccgtgccctcccggaccataggggcgtcaaagtaggcattgcagatttggcagtgcttcatgactcgcccccgatccggaacgcatcttccgcgggaatacccatgagacgagccacactgtcccggaatggcttggaggcagccaaccgcccggagagcatctggtatgcctgggcgtatgagacgctgcccacgtcctgaatgaagctcttgaccacgccgccatagttttctacaatgtaccttcggatgaccggatacagcacggacgggggccggggcgggattcggatgcaggccgataggtcattcttgatggtgcagtccgcgtatccgatttcccgggcgatctcctgccagttgtggccgtcgatccgcatcgtgaatgccttgatacgtttttctcttgtcaaatagctccctcctcgatgaaatagattgtagcggtacggactccggcctggatggcggcctcgtggctctccatgcagaggtcgatgtgggcgcctttcacggcgcttccggtatcgtccgcccggtaatagtggagttctccgtctccgtagtccaccaggacatcagaacccaatgggatgatggacgggtccacggccacagagacgccgggcgtggcccttctgccgctggcggtgatgccgtcggacttgccgcagcagcgggagcaggtgcagtagtgggtgacggtgacatcatccaggcggacggcatgggacagcagcgccgcctcgatcagctcgttttccgcggcctcctgctcctcttcggtgagataacagcggaccagggccggggtatcgtcgccgggtaggctgccgtcctgcgtggcgggctccggcttgtgcatggcgggccgatctgctttcaccgtcataatcaggtagcttcccagccacgccagcagcaagatcagaaataggagatatgtaatcagctgccgcctctggctccggcgccgccgctcttcgcgggtcagctttttcataggatatgcctcaccgcttcttctcgggtaatatagaaatggatgcccgtgctgcactcgttccagcggttttcgtcgaaatccgaaacggagaccacagttccgggaatgtaatggaagttctcatctctatcactgacggcgacctgctccaatacaatcccctctaaatcctgaatctccaaaacggttgcctttgagcagcggcacttccggcctgttccggaactgcgcacggcatcttcggtaatttccagctttacaatgcactcatgaccgctggttttgacccttgcctttttccagccgacaaaagcgccgatttccgggcaggcaatgggataaaataaattttttgccttttcaatgtagtcggccctggacaggtcggccctggacaggttggccccgaacaggttggccctggacaggttggccccggacaggtcggccccggacaggtcggccctggacaggttggccccgaacaggttggccctggacaggttggccccggacaggtcggccccggacaggtcggccccggacaggtcggccctggacaggttggccccgaacaggttggccccgaacaggttggccccgaacaggttggccccgaacaggtcggccctggacaggtcggccctggacaggtcggccctggacaggttggccccgaacaggttggccctggacaggttggccccggacaggtcggccccggacaggtcggccctggacaggttggccccgaacaggttggccccgaacaggttggccctggacaggttggccccggacaggtcggccctggacaggttggccccgaacaggttggcccgttttccgccattttcgcctcgtagccatttaaagtgcttgtccaaaatatttttcaactcttgttcgtccatgcgttattcctccttgtaggtctcccggaagctgccttcggggaaatcgaactccacggtgaaatgatggtgccgctcgttgatggagactacccggcagggatgcgggcctgtccttgcggtcacaaaggcgctggtggggatggtgggttccaggcacagcttgtctccaatgttcatctgtggccctccagtctgtccagtatccagaagagaccgtttgtcagggagatggctccagcggtcagaacgatgatttgaaggatcatttcgacacctccgaaagactccgggccagggtggcggcggagattttggagccgttgaaggggaagcggttcttcaaagtgctgtatttcttgatgccggtgaatcgccggacatcctccagggacagcaggtgccgcccttcggtgaattctagaatgtccgcgaggttgtcgcggtagtatcttgactcagacattcgggtcctccttttcttgatggtcgtggttgctgttcgggtctgacgggcgaaggcgcagagcctcgtcaaaggtcatgccgtaggccgcccggttgagcttgtccatgagccgcttggtgttgcgtgcctgggactccaggtctttgatggtgctgttttcgttcaaagtaaattcctccttgcgattgatttccgcccggaggaatggtatactgtcctcgcgggcctgttggcgctttcaataggttccgcagccctcgtcggtggtgtcagcactggcgggggcattttgttattcaatctgagtaaaatccgttctctttttgcagaaaaagcaatacatggttttcctgtgcccaggcaaggtggcgcctctatgtctcatttttgtggccggagtgattgccccgcagacatcgcattgaaagaggcgcttttggcacgtttgctctcgaatccttttcattgaaattttcagatcgtcatatctcctatctgtttatattgccgattttattgatatgtggtatcctgataacaaggagtgtgttgccgcatgatgacttccgaacaagcggaaatgctgcgaaggaccatccagggcgtccggttttctgacttaacagaacgtgaagcggacatgctgcggtggctgatggcaaagccaagggatattgctccgcagatgtgcagagagacctggaagccatctttgccacgcaggacggcctttgcgcccttgccacttatgaccatgagaagatcatggaaaagcggaagaagctggaccgctggtatcaagtcctcttactggtgatcggcgccttgatcgggcagcttgtggagctgctcttttccgccctgctctgaggccctgtagacttgggccagatttcgcagatacagagaccagaacttatcaaatcgggctgtgtcatagccgctttccgtttcgggaatgatcccggcgtcgatggcggccagaagggcacagcccttttcgtttgcaaatacaggtgtttccatacggacctcctttttagctggcgtactcatcaccgtcctctgcgaataggtattcaaacttcttcccgaaatactggcagtaggcacggcactctgcgggagtgaagcgtcctgactttgttttgctctgataggcggttcggctgactccgatgatccttgccatatcctcttctgtcagcttatgcagggctttctgccccaggagattagggaacatatttcacgcttctttcactgtttgcgttccgaaaactctagttatatgatagtctcgatttgcaaacttgtcaagagatattggcaaaaaagtttgcgttccgaaaacttatcattgacatttgcaaaatgcaaacttataatgaagctgaggaggcgataatgtgacttttggtgagagattaaaagagttccgggaaagctgcggttatacacaagaggaactcgctgaaatggtcggcgttgcaaagaccacgatcactggttatgaaaaagggaatcggaagccggatgtccccaaaataaaaaagctggcacatgctcttggcattacaggcgatcagcttttggggactggattagatataaataaagccccgctctattcgagcgaggcgatgcggctggcgaaagactatgacgggctggaccgctggggcaagcaggcgctccggcatgtagcggatgtagagatggcccggatggaagatgaagagagatttctgcgggatgcaggcgaatcggaggaagaaaagccaacaatcccaaacttctggtcggagcctgcggccggtatggcctcccccatcatgggcgaggattacgatgaatacaccttgcagccaggagacccgaagggcgccgttttctctgtgcggatcagcggcaacagcatggagccgtatttcccgaatgggagcagggtcttttgcaataaggacccgctgcgagatggtgatattggcgtgttctccgtggacggtgaagcggtcattaagcaataccactatgaccggattctggggatcacctatttgttttccctgaaccgggagagagcggacgcggatgtggtgattacccgcaacagcgggcagatgttggtctgcctggggcgcgtcattacgaagcggcgattcccgttgccgggaatgtaaaaagaaagaccgtccgggcgttgacgcacccggacggcaatgcaaccaaccagcaaccacgacgaagccaggaggtctgttcacagtatagcacagacctcctgatgaagcaataggaggaaaagaagatggcgaagaaaagcaagtatcatcagaggccggacgggctattcgaggcgatccggaccatcaacggaaagcgggtggcattccggggaaagagctgccgggaggtggacagaaaaatcctggaataccaggagcagaaagagcgtgggcgggacttcccaaagatcgcggacgagtgggaggtgcagcatgaaggggatattggagaatccacgcggcgggtttactcctacgccgtgaagcggctgaaagaggcgtttcccggacctgcgaaggagatacggcccctggacatccagcggtatatctccgcctttgagaagcaggggaggagcgccaacagcgtttctattgaattgtgtgtctgcaagatgatattcgcccatgcggtgatctccggagatattgatatttccccggctgcggagatcaagaagagccgggggctgcctgtgaagcaccgggaggcgctgaccgaagagcaggaggccgccgtaaaggcagcggggcgggagaagaaagcccactggtggctgtttccgtatctactgctttatactgggatgcggcggggagaagccctggcgctgacctatgcggacattgaccggaaagccggagtcatccatgtgaccaaaaaactaaactacgcctacagtaccacaccgacactcgaaaaccacttgaaaagcgagaacggcagacgggacattccgttgctgcagccgctggcggacgcgctgcccaaaaccagagcggggctgatcttcccaggcagagacggaggatttatgaaacaaggggagatcgctaaaaactggcggaggtactgccaggatgtggggctgaatgaaatcgtccagaccagcgacgggaaaatccatgagacattcccaatcacgccccactgtttccgccacagcttcgccacgatctgttatgaggcggggcttgacccccggcaggctgcggagatactgggagacacaccggaggttctggagagcgtttacacccatctgcgacaagagcacaaggcaactgcggcccagctgctgggagcttacatggacgccagagatggatagttttccacatagttttccactgtgaacgttatgcgccgctaactgtgaatttactgtgaatttcaggggtaatttacagtaacataaggtaacttaatcggatgccgcgaaaagctagagccgcaagggaaagacagtgatttcagccgttggatgaaattcgatgaaattaaacagtctgtaaaaacaaatttgcggcgtttacacatcttttcatttgtggtatactgcattcgtcaaattctgcgccggaggaaatggaaacgcccatgtggaaccgactgaaagccattctggcagacttcatccagcaggccgacctggtgctgctggggctctgctgcgccgccaccctgtacggcatggcgctgatcgccagcgccacccggtatctgaacatcggcggcatcgtgcgatatgtgggcgtccagggggcggccatggtgctgggcatctgcgcctatatcttcatgtccatgttggacctggagcggctgatgcgacggtggaagtggcttgtggccttcaacgtcgtgttcatcgccctgctgctgacaccttttggcgtctcggacaacacgggcaacaccgcatggctgaaatttccctttctccccttcagcatcggcccggcggaggtggtgaagatcaccttcaccctgctgctggccaagcagttggagtggctgcgggaggtgaagcgggatctgaaatccttcccctccgccctgatggtggcggggcacaccatcgccctgatggggtggtacgtggggatttccggggatatgggcaacggcctgacatttttcttcatctttctgtgcatggcctttgtggcaggcttcgctctgcggtggttcgtcctgctgttcgccggcagcggggcagccattgccgcctcggtggctctgggcctgatgccggactatatgatcaaccgtttccgggtcctgtttgaccactcctatgataccctgggagcaggctggcagcagacccggggcctgctggccctgggctccggcggcctcttcggccagggatacatgcagggcacccagactcaggcgggggaggggtccctgccggcccggcacacggacttcatcttctgtgtctgcggggaggagctggggatgatcggctgtcttgttgtgatcgccctgctggcggccatcatcatccgggtgctgctggtagcccgccgggctgagacgcccttccactgctatgtctgtgtgggtgtggcggccatgctgatcttccagactgtggtgaacatcggtatgtgcctgtttgtgatgcccgtgatcggtctgaccctgccgttcttcagctacggcgggtcctcgctgttgacgctgtatgccgccatgggcgtggtgtccggcatcaaaaagcgatcccctgtggtccgccgtccgggcaggcccctggggtgagcggaaggagctcccaaacacggccggagtgcgctccggccgtgtttttctgcatatttccggcgggcgggaagaaactagcggtgcacccaattcaatacaggaggtatgatcgccttgaagacccaactgatgaaacgcgccgccgccctgtgcctggcggtagtcctgaccctgtccgtcaacgccgccgccctgttcggcggcaaggagaaggcccagccggcagaggggagccccacggcccaggcgctggagatccgcacctaccggggcattccctatcacgcccagtttctggccgcgggcggcgagggagaggacctgaccttcaccgtggagaaagagcccaaaaagggcaccgtccagattgacggcgccagcttcacctataccccagagggggattccaccggaagcgacagcttcacctataccgccaccgacagcgccggacgcgtgtctcaacccgctacggtgagcgtcaccattgagaaggccaagtctggcgtcacctatgcggacacggcggacagcaccgccgcggtggccgcgcaggacctggcggaggcggggattttcaccggtgccaagatcggagaccagtactactttgagccggataagcccgtctcccgcagcgagtttctggccctggtaatggagaccgccggggacgaacccaccgccgttaccatgaccggcttctgtgatgacgcggccatccccacctgggccaaggcctacgccgcggccggcgtcgcggacggcatcattcagggcgtctccacagcggagggcgtggccttccagggagatgagcccatcaccttcaatgaggcggctaccgtgctcaaccgcgtcctggcggtggaggatgtggatctggccagctggtacgcagaccgggaggcagtgccctcctgggcagcccaggccgtggggaacatggaggcggtcagcgtcctcgccgcgggcagcttcggcagcgccgccatgggagagaccgtcacccgggcggacgcggcccagatgctctccgccgccggcaccctgctggagggagaaccggccggcctcttcgactggctcctctgagccggaaatttccagcagaacaaacagccctccgaaaaagcgcccgtgctttttcggagggcctgcggcgttttaacagttgtatttgggggcggtttgtgctaaactatggaacattaaaataggatgattatgactacccatcggagagcagtcaagatagaagggactggaaacgagcatgaagatcgttgtattggcgggggaatctccacagagcgggcggtctccctggtgacgggcaccggcgtgtgccgcgccctgcgggaaaacggccatcgggccatcctggtggatctgttcctggggctggaggaggtcccggcggacctggagaccctgtttgacgcgcccgacggcctgtgccccgacgcgaagatcgaggtggaggcgccggacctggagacggtgaagcgcggccggaaggatcagggccccagccacatcggcccccacgtgctggacatctgccagaaggcggacctggtgttcctgggcctccacggtatggacggggaggacggccgcatccaggccgccctggatttactgggcgtgccctacaccggcgcgggtcatctggcctccgctgtcgccatggacaaggcggtttccaagcagattctggacgcgtgcggcatccccacccccaagtggcggctgctgtcctatggactggatgaggcggagcccctggcccagacgctgcctatgccctgcgtcatcaagaccatcgggggcggttcgtccctgggggtgtacttaccggaggaccggacggagctgaagcgggccctggaggaggtgctgcgctacggcgccaaggtcctggcggaggagcggatctacggccgggagctgacagtggcggtcctgggggaccgctggctgccggcggtggagaccgtgcccgccggaaaggaatttgactacgtggccaagtaccaggccggcgcggcggtggagacctgtccggccgatgtgccgcccgcggtgatgcaggccgccggtgagctggccctgcggacccaccgggcgttgggattggaggtctactcccgcacggacatgattctggacaaagacggaaatctgtgggtgctggaggccaactccctgccgggcatgacccccaacagctttgtccccaaggaggccgccgccgtgggcatgagctacaaccagctctgcgaggagatcgtgcggctctcctgcgacgtgaagagaagagggtgaactgcatgcagccaatgaccattcctgagatcatatccgctgtggacggcacctggctgaatccccggaagggggcggcccccgtcaccgctgtgtgcaccgacagccggaagattgcccccggctgcctgttcctgccctgggtgggggagcggttcgacggccatgacttcatcgacagggccctggacgcgggagccgccgggtgcttgtgcgcccggaggccggagctgctgcggccagacaagttctatatccaggtggcggacacccggctggccctgcgggccctggcgtccgcctaccgggaccggttcgccatcccctttgtccaggtcaccggcagcgtgggcaagaccaccacaaaggagatgctggcggcggtgctgggggcgaagctccgggtgctgaagacaccggagaacttcaacaacgacatcggcacgcccctgaccctgctgggcctggggccggagcatcaggcggcggtgatcgagaccgggatgaaccacttcggggagatccgctatttgggggagatggtgcggccggacatcgccgtcatctccaacatcggtgacgcccatatcgagcatctgggcagccgggaggggatcctcaaggccaagagcgagatttttgagaacctgaagccggagggactggcggtccttaacggggatgacgccctgctgaacaccctggacctgcccttccggaccgtccgctgcggacggtcggagcactgcgccgtccgggtgatggacatggccgaccacggcgtggcgggaattacctgcaccgtcgtgtccccccgggacacctatcacctgaccatccctgcgccgggagagcacatggcctactctgccgccatcgccgtggcggtgggagaggagctgggcctttccacggaggagatcacccggggcgcggcttcgtatgaacccgccggatcccggatgcgggtgcttcgtctgcgggacgggcggctggtgctggatgactgctacaacgccaatccccagtccgtcactgcggccctggagatcctggccaagactgagtgcggccggaaggtggccgtgctgggggacatgggggaactgggggacctgacggaccaggcccactacaacatgggcgccctggccgccatgctgggcatcgacgaggtggtggccatcggcgccaaggcggagaagatcgccgacggcgccgcccagagcggcggctccgtcacccattttgccaccaaggaggaggccgtccacgaattgactgaccagctgggcaccgacactgccatgctggtgaaggcgtcccacgccatgcactttggctggatcgtggagcagttgaaacaagcgtatgattgagattcaagtgaacaacctggtgaagtcctttgaggtggggaagaacgtcctggacggcctcacctttcaggtggaccagggggagcgggtggggctgctgggccgcaacggcgcgggcaagaccaccctgttcaagatactgaccggcgagctggactacgacgagggcaccgtcgtggtgggccagggccggcgggtgggcctgatctcccagatccccgtctaccccgccggctgcacagtagaggatgtgctgcgctccgccttcgcccggctggagagcctggcggaggagatgcgggccctggaggcccggatggccgccggggagagcgaccctgccattttgaagcggtacggcacattaagcgagcggtttgaggcatttggcggctatgacacagatgtggcggtgaataagatcgccaacggcctgtccattccggacagccagcggtcccagctgttcgacagcctctccggcggggaaaagacccgggtgaacctgggccgcctcatcctggaggacacggacatcctgctgctggacgagcccaccaaccacttggacctccacgctaccgagtggctggaggagtacattcgctctttccacggcacggtggtcaccatctcccacgaccggtatttcctggaccgcaccgtcacccgggtcatcgagatccaggacgggaaagcggagttttacagcgggaattacagcttctacgccgtggagaaggaacgccgctaccaggagcggatgaagcagtacgaaaaagagcaggccaagatcgcacagttggagaaggcggcggagcaattgcgggtctgggctttcatgggcatggacaagacctaccgccgggccatctccatggaaaagcgcatcgagcggatgcggaccacctccaaacccaccaaggcgcggaagatggacgcccggttctcctccgcagagttccacggggacgaggtgctgggcatccggaacgtgtccaagtcctacggggacaagcacctctttgagggcatcagcctgaaggtggaggggggcgagcgcatcgccctcatcggcgacaacggcaccggaaagtccacccttatcaagatgatcgtgggggagctgtatccggacgacggccgcatcaaaaccggcccccaggtgaaggaggcatacctgccccagatcgtccgcttcgaccacccagactggaacctggtggagaatatgatggcggcgaaaaagggcctctcggcccagtcggcccgaaaccggctggcggcatacgacttccggggcgaggacgtgttcaagccggtgtcggtgctctccggcggggagcagagccgcctgcggctgtgcatgctgatggatgacgagatcaacttcctgatcctggacgagcccaccaaccatctggacatcgactcccgggagtggatcgaggaggcggtggaggcctacgacggcacgctgctgtttgtcagccatgaccggtacttcatcaaccgcttcgccacccggatctgggagctgacggatggcaccatcacggattatccctgcggctttgcccaataccggcagatgaaggctcaggaggaggcggagaaggccgccgctcccaagccggagaaggagcgggaaaagcccgctgcggagcggccccagcggggcaacaaggctcagcaggcggcccgacggcagctgaccatctgtgagcgggacatcgccaaggcggaggagcgcatcgccgctctggaggcagatatggaggccgcggcctgcgactatgagaagctgaacgagctggtggggcagaaggacgccgcccaggcggagctggacgccctgtacgaaaggtgggagcagctcagtgaagaggcagagggctaaacagcggcccctgtaccggtacgatgtctaccggggccgcagaagaggacaggcccggctgatcggggcggcgggctgcgccgttttcggcctgcttctggtgctgatccggagcctgggcatccggttttccggctttctgctgctggggctggcggcgctcctggtgctttcctggctgctggatcgcctggccgccggaaatcaccgctggcggctgatccgccggggcttttatggctgccttacggtgggactggctgcgctgctggggctggaggtctttatcattaaccgggggcgcagcgacatgacgcccctgccggcagacgcggtcatcgtcctgggagcgggggtcaacggcacggagccgtcgttgtccctgcggacccggctggacgcggccctggactatctggaggcccacccggagatcccggtggtgctcaccggcggcaccggctatggcgaggagatcagcgaggcggcgtgcatgtacgactacctcacggcccatggcgtggagccggggcggctgattctggaggatcaggcatccaacacggcggagaacttcgccctctccaagcccctgctgtatgaggcgggggtcgacccagcggagggacgggtggctgttgtcaccaacgactttcacatcgcccggtcggagctgatcgccgcccgggagggctacggagacgtggccgggatcccagcgccgctgccctgggttcatttggagatcaattacaccctgcgggaggcctttgccatggtaaagacctttctgtttgactgagcggatacggaggaaccaaatgagcgatatcttatgtatctattactcccggacggggaacaccaagaaggccatggaggagattgccgccgccctggacgcggagctggcggagctgcgggacaacgcggaccggagcggctggcggggctggctgcgctgtgggctggacgccatgcgcaaagacacccgccccgtggccccgttggagacagcccgtcccctgggggactaccgcttggtgattctgggcacaccggtgtgggccgggcgatccagcgccgtcatgcggtcgtttctgaaagaccggggcggggagatccgcaacgcggcctatgtgctgacccgcagcagcggctcccagtaccaggaggtttatcgccagatggatctctgtgtgcccgccggtcatctggcggcggtgtccttgcggagcggggacgtgggctgggcattctggcaggaggagtttctccgccaggtccgggcctttctggaggggcagtagcggcagacccttttctgaaatcaacgggagaggagatgccccatgcaggaaaaactgaaggagctggccctgcggtatgaggacctgcaagcccagctggcagacccgtctgtctatggcgacgcggagcggctgaagactgtgaatcgggagctgaaggacctgactccggtggcagaggcgtaccaggcataccggcaggcggaggcggaccgagccgcggcggaggagctgctctccgacccggagatgcgggagttggcccaggaggagctgaccgccgcacgggaagagatggagcggctacggcaggagctgaagctcctgctgctgcccaaggatcccaatgaccggaagaacgtgatcctggagatccgggcgggtaccggcggcgaggaggcggcgctgttcgccgcgtcgctgctgcggatgtacaccatgtacgctgccgcccggggctggaggactgacaccgtggagctgaacgagacggagctggggggcgtgaaggagtgcagcgtccttatcgagggcgagggcgcctggtcccggctgaaattcgagagcggcgtccaccgggtccagcgggtgccggtgacggagtccaatggccgcatccagacctccgccgccacggtggccgtgctgccggaggcggaaggggtggacgtgaagctggaccctgcggacatcgagatgcaggtctaccgggccagcggcgcgggtggccagcatgtgaacaagacgtcctccgccgtgcggctgatccaccggcccaccggcctggtagtggaatgccagcaggagcgcagccagttccagaaccgggacaaggccatgcgccttttggcgtcaagattgtatgagatcgagcgggaaaagcaggatgccgacatcgccagagagcggaagagtcaggtgggcagcggcgaccgcagcgagaagatccgcacctacaacttcccccagggccgggtgacggatcaccggatcggcctgacgctgtaccggatcgacgcagtcctggacggggaactggatgagctcatcgacgccctggtgaccgccgaccaggcggagaagctgaagaacggcggcggggaaccataaaacagagctgtacggcggcccggatagagcggcgccgtggaggggctgcacttccggcagcctgccgggacgccgcggagccctttggagacgcagaaagagtaagcaataaggccggggagatctccggcgaagagagatagaggcgaagagatatgcagacacgatattttgacctgcgggacaccaagggtcagcagaaggagatcgaggacaagatcggcgcagcggccaagatcctgcgggacggcggcctggtgggcatccccacggagacggtgtacggcttgggggccaacgctctggacggcaccgcggtgaagcggatctttgaggccaagggccggccccaggacaatcccctcatcatccatgtgaccggcgcccagtggctgccccgctactgcgccgacgtgccgcccctggcctatgtgctggcccggaaattctggcccggccccctgactatgatcctgaagcggcggcccatcatcccggacgagaccaccgccgggctggacacggtggcggtgcgctgccccaaccacccggtgacgctggcgatcatccgggaggcgggcatccccatcgcggcccccagcgccaacctctccggccggcccagctgcacgactgcccaggacgtgctggaggatatggacggccggatcagcggcgtggtggacggcggtccctgtgcggtgggtgtggagtccacgattctggacctgacctgcgacccgcccaggctgctgcgtcccggcggactgcccctggaggacctggagcggctcatcggcaagatcgacgtggataaggccgtcaacggcgccctggcggagggcgagaagcccaaagcccccggcatgaagtaccgccactacgcccccaaggcgccggtcaccgtcatcaccggcgcgccggagaagtccgcccaggagatcctgcggcgggtggggcccacttccggcgtcatctgcttcgaggagtttgcggatctgttccgggagcaggaggtccacaccctggggcctgtaggcgacaagctggtccaggcccagcgggtgttcgacgccctgcggacctttgacaccagcgatgtgacggagatcttcgcccagtgcccggacaaccggggattgggtctggccatcggcaaccggctgaaaaaggccgccggcttccatgtggtggaggcggacagtgagcgggtggtgctgggcctcaccggcggcaccggcgcgggcaagtccagcgccctgcgggccatccgctccctggggggcgaggtcatcgactgcgacgccctgtaccatgagatgctggagacctgcgctcccctgcgggatgagatcggtgtctccttccccggcgcgtttgacgcagccggccaactggaccggcgcaagctgggacaggaggtcttctcccacaaggaccggctggagcagctcaacggcattgtggcccgccatctggtgccggaggtgcggcggcgcttggcggcgtcggagagcaagatcttcgccatcgatgccatcaacctgctggagggcgggctggaccagctgtgcgaccggacgatagccgtcaccgcgcctttggaactgcgggtccggcggatcatggcccgggacaacatcacagagcagtacgcccgcctgcggatctccgcccagcagccggacgagtactaccggggcaagtgcgactgtgagctgaataacgccgccgataccgccgcggcctttgaaatggaggcccgggagtttttccagcggctgatcgacaccatcaaggaggaaaaagcacatggaaagcaaggaatttaaggcgctgaaggagcagctgctctcctgccgccgcaacggcttcgaccggatggacgcggcggagcggagcgccatggaatcgtactgcacggactacaaggcatttctggacactagcaagaccgagcggctctgcgcaggagaggttgtccgcctggcagagcaggccggctaccggccctatgtccggggcgcggcggtgaagccgggagacaaggtttatctctgtaaccggggcaagagcgtgctgctggcccacatcggggagaagccgttggcggagggtgttcagatcgctgccgcccacatagactcccccggctggacctgaagcccaaccccctgtatgaggacggggaactggcctatttcaagacccactattacggcggtatccgcaagtaccagtgggttaccattcccctggagctccacggcgtggtggccctgcgggacggcgccagcgtacaggtgaacatcggcgggggcgcggacgatccccggctggtgatcacggacctgctgccccacctgggcgcggagcagaacaagaagccgctggcggaggccatccccgctgagaccctgaacctgctgctgggcagcgagccgatcggggacgcggaggagtccggccgtgtgaagctggcggtgatgaagctgctgaacgaaaagtacggcatcacagaggatgacttcacctccgcggagctggaggcggtgccggcggtaaaggccacggacatcggcctggatcgcagcatgatcggcgcctacggccatgatgaccgggtgtgtgcctacgccgccctgcgggccctgctggatctggaggggacccctgccaagacggcggtgtgcgttctggcggataaggaggagatcggctccgacggtgtgacgggcatgcagtccgccgctttcgacacatttatggaggacctgtgcgagagccagggcgcggctgtgcgggtgtgtttcgagaagtccttctgcctcagcgccgacgtgacggcggcctacgaccctaacttctccgacgtgtatgagaagcgcaacgccgcctatctgaactacggcatcggcctgtgcaagtacaccggcgcccggggcaagtctggtgcctccgacgcggacgcggagacggtggcctatatccgcaacctctttgacgaggcgggggtcatctggcagatcgcagagctgggcaaggtggacgccggcggcggcggcactgtggccatgtatatggccaaccggaacatcaccacgctggacgcgggcgtgccggtcctgtccatgcacgcgccctttgagacggtgtccaagctggactgctacgagacctataagggcatgaaggccgtattccaggcggagaagtgaatcggctgagatcaggaaacaggcgccccggtgaaaaccggggcgcctgtttctatccggcattctgctcaggtgagggggagaaaaccgggggaacttttcctgttttcgtcaaaagaatttcggcgaatttggttgcattgcctacggaaatatggtaagatgctttgcgtgtaaagacaaatggccataggaggcggacgagatggcgagagagatcaagtattacattgtggccgcgaacgccctgccggagatcttcgtgaaggtggcggaggccaagcggatgatgcagaccggcgaggcggacaccgtgggcgctgccacgaagcaggtggggatcagccgcagcgcgttctacaagtacaaggatgcggtgcagccgttcaacgatatgaaggcggagcacatcatcaccttttactgtatgctcaaggacaacaccggcgtgctctccagcgtgctgtccgtgtttgccacttctggggccaacatcctcaccatcaaccagagcattcccaccaacggctgcgcggcggtgacgatttccgcagagaccagcggactggcggagaccctggagaagctgatggcagacgtggccgccgtggacggcgtggtacgggtggaagtcctggcaggataaagagagaggaaacggacgcatgatacagattgcgattatgggccttggtacggtgggcaccggcgtggccaaggtagtggcggaaaacgcccggcagatcgagcgaaagctgggcgagcccctgcaggtgaagaccattctggtgcggcatttcaaggacgggccctaccgtcagctgatgacggatgacttcacgaagatcgaggaggaccatgctatccgggtggtggtggagaccatcggcggcgtggaggcggcctacgagtacacgaagcgggccctgaacgccggcaagcacgtggtcaccgccaacaagcagctggtggcggagaagggcgcagagctgctggccctggccaaaaagcggggcgtgaactatttgttcgaggccagcgtgggcggcggtatcccagtgctgcatcccctgacccagtgcatggctgccaaccggatcgacgaggtgtacggcatcctaaacggcaccaccaattatatccttacccggatggtccgggccggcaccacctttgcagacgccctgaaagaggcgcaggagaagggctatgcggaggcagaccccaccgcagacgtggagggcgtcgacgccgggcggaagatctgtatcctggcggatctggccttcggctgtcaggtggacccggcggatgtgcccatggaggggatcagccggctgtctctccgggacgtgaagatcgcccagcgggcgggctaccgcgtcaagctgctgggccgggcggtgcgcctgcccggcggccgtaccgcctatgtggcaccccatctgatcccggaggagcagcccctggccagcgtggacgatgtgttcaacgcggtggtggtccggggaaacgccaccggggaagtgatgttctacggccagggggccggggagctgcccacggcctccgcctgcgtggcggacgtgatggaggcgcttcagtccagcccccgccgggaggagatcggctgggaggcggacccggcgggctttgaggacccgcaggcccttcggagccggtactacttccgcatcggcggcagcctcagcgccgctgccgcggccttcggccaggtggagatcctcagcgaggacggcggtgagaccgccttcctcaccgactgcatcagcggagccgaggcagggaagcaggccgaaggcctgcgcgtcctggcctgtctgcgggtgctgggataagccccaaaccgccggaagatgtgtatactggaacaggcgggaaccgggatttgagacttgattctgatttaaagaaggaaatgccatgagcttgatcgtacagaaattcggcggcaccagcgtgagagatgccaagcgcatccgcaacgtagccggcatcatcgcagagacctatctggcggggaacgacgtgattgtggtcctctccgcccagggagacactacagacgatctcattgccaaggcggaggagatcaacccccacgcctccaagcgggagatggatatgctgctctccacgggagagcaaatctctgtggccctgtgcgccatggccctggaggccatgggcctgccctgcatatccctggctgcttggcaggtggggatacagtctacctccgtccactccgacgcccggatcaagaagatcgacaccgagcgtatccagtccgagctggaccagcaccggatcgtgatcgtcaccggcttccagggcgtggaccgcaacggggacgtgaccaccctgggccggggcgggtccgacaccagcgccgtggcgctggcggcggccttccgtgcagatctgtgccagatctacacggatgtggacggtgtgtataccacggacccccgcatcgtccccagtgcccgcaaactggatgagatcacctacgacgagatgctggaactggcgtcgcagggggcccaggtgctccacaaccgcagcgtggagctggccaagaagttcagagtgaatttggaagtcgtgtccagcctggagcgcaagcccggcacgaaagtcaaggaggtcaccaaagtggagaaaaccaatatcgccggtgtcgccaaggacaccagcatcgcccgcgtcgccctgatcggtctgcagcacaacccaggcgtcgcattccaggtctttgacctgctgagcaagcacaacatcaacgtggatgtcatcctgcagtccattggccgggaggacaccaaggacatcaccttcacggtccacaagaaggacctggaggaatccaagcagattctggaggaacataaagagaccctgaggttcgaccacattgagacggatgagagcatcggcaaggtctccattgtgggcgcgggcctcatgagcaactgcggcgtggccgcccggatgttcgaggccctctatgaggcgggcatcaacatccagatgatcaatacttctgagatccgagtctccgttctgctggatgaggaggacgtgaaccgggcggtccgggccatccacgacaagttcttcggcgagatctgattccgcctggagcatcagcccagcagggcgcgcccaccggcgcgccctgtgctgttttccggtctgctccgccgccgcgctgcatacagtggagcgaggtgaggcgaaccatgagagatcccttcaatcgttttgccctgcggtatctggcggctgtggtgtgcggcctggcactgctgctgctccacagcacggcacaaagcggactgcctgccgcgttcgtgccccagtgtcccagcccctgggagttgagcaagctggccttctggccgctgcttgccgcctgggtgctgaccggccggctgggcagggagcgccgcacgctgctgcaggatctgccggcagcggtgctgacgcccctggctatgacagcggcgtgctggggcttggcggccgccgggggaaacggcgcggcgagcctggcggtctgggcggtgctgctggcggcgggcacggccttctgcccggacggaagaaagcacccggggctgtgggcagccctggctctgcttctggcggggctgtacatgctgctgaccttcacgcctccgggctggggaccattcgtcaatccgctgggatgagagaggatttactttcccgcccatctgtggtacaatacggacgctgtatacaagagaatgccgcctcgccgggcttgccggcgggcggccatgaggaggaacttcgctatgaacgccatcgtcaccgtcgtggggcaggataaggtaggcatcatcgccgccgtctgcgccctgctggctgagcacaatgtcaatatcctggacatctcccagacgatcctccagggctccttcaccatggtcatggccgtggacgtgggagcggccaaggtctccgtgggcgagctgcgggacctgctggagcagttggggcagaagatggagatctctatccgcatccagcgggaggagatatttgatgccatgcatcgcatctgacttcaagagggagctgcgcccaccctttagattccccctccccagtgagacgttggtcactggggacgccgtccccggcggctgggtcaagaaattttcggcaggtacacgccctgccgaaaatgatttaatattcttcttttgccggaggtaaaagaactgaggaaaaccggaggttttcccctagcctcttttacccgtttccggagtccttttgagagagaatttgtacgttgggagatacgttatgctgaaccagaaggaaattttatctaccattgagatgatcgaccagcagcacctggacatccgcaccatcaccatgggcatctccctgctgagctgctgtgatccggacccgaagcgggcctgtgagaagatctacgacaagatcacccggtatgcggagaagctggtcaagaccggcgaggacatcgagcgggagttcggcatccccatcgtgaacaagcgcatttccgtcactcccatggccctggtggccggggccagcgagacggaggactgcgtgccctttgccctggccctggaccgggcggcccagacctgcggcgtcaactttatcggcggctactccgccctggtgcagaagggcatgacagaggcggacgagaagctgatccgctccattccggaggctctggcccggacagaactggtctgttcctccgtcaacgtggggtccacccgggcgggcatcaatatggacgcggtggccctgatgggccgcatcgtcaaggataccgctgccgccacggcggaccgggatggcctgggctgcgccaagctggtggtgttctgcaatgccgtggaggacaacccctttatggccggcgccttccacggcgtgggagaggcggagaaggtcatcaacgtgggcgtctccggccccggcgtagtgtgtactgctttgaaagcggtgaagggccagccctttgacgtggtggcggagacagtgaagaagaccgctttccgggtgacccgcatgggccagttggtggcccaggaggccagccgtcggctggacacgcccttcggcatcgtggatctctccctggcgcctaccccggccatcggagacagcgtggcccgcattctggaggagatgggcctggaggtctgcggcacccacggcactacggcggcgctggccctgttgaacgacgcggtgaagaagggcggcgtcatggcgtcctcctctgtgggcggcctctccggcgccttcatccccgtcagcgaggacgagggcatgatcgccgccgcagaggcagggaccctctgcctggacaagctggaggccatgacctgcgtctgctccgtgggcctggacatgatcgccgtccccggcgacaccccggcagagaccatctccgccatcattgcagacgaggcggccatcggcatggtgaacaacaagaccaccgccgtccggctgctgcccgcccccggcaagaccgtgggggaccggatcgagatgggcggcctcctgggcagcgccccggtgatgccggtgcacccggagtccagcgcggactttatcgcccggggcggccgcatcccggcgcccctccacagcctgaagaactgagccagcgggccgtccggaagggcggcctgttttgccatacagatggggaaaggcgttcagatatgccgcagcttcatgtgcagcagggctcacgccttttcgcggcatactgtcctatacttggagtttcacgccggggtatgggacgcgccctgccgcggtaaactgggagaaaaggaggaatcgcatggacattctctttgaaaacggcaccatccgcactctggagcggaacagccctgatgcccaggccctgttggtgcgcaacggccggatcgccgccgtggggggcaggacggcggtggaggaccagacgggaatcgacgtccgccgggtggatctggcaggcaggacgctgctgccggcgtttctggacgcccacagccactttacggcggtggccaaccagtttctgcaggtgtctttggagggctgcacctcctgggcggacatgcaggaccggatccgggactacatccggcgggagcgcatccctgccgggcagtgggtaacggcacaggggtacgaccacaacctgctctcggagcggcgccacccggatcggctctgcctggatgcggcggcgccggacaacccggtggtgatctgccaccagtccggccacatgggcgtgttcaacaccgcggcgctggagcggctgggtgtcactgcgcagacgcctgcccccgccggaggcgtcatcggacgggagaacggcaccctcaccggctacatggaggaaaacgcctttctggagttccaaaagcgggtgcccatgaggccgctggagtcgtttctggcggcctaccggaaggcccaggacctgtacgcctcctacggaatcaccaccgtgcaggaagggctgctgcgccgggagctggtacccctgtatcaggccctgctggcggacgggtccctgaagctggatgtggttgcctacggagatccggagggagcggaggcggcccggcaggcatttccggagagtgtccggcaatatcaccggcgcttcaagctgggcgggtacaagatgtttctggatggatctccccagggacgtaccgcttggctgcggcggccctatcagggggagcaggaataccggggctacggcaccctgacggacgcagaggtgctggacatggtccgccgggccgggacagatggaatgcagctgctggcccactgcaacggggatgccgcctgcgcccagtatctggcggcgctggatgcggcggcgcgggaaggcgtggatctggcggcactgcggccggtgatgatccacgcccagctgctgggcagggaccaactgccggaggtgaggcggctgggggtgatcccctctttcttcgtggcccacgtgtaccactggggggatgtccatctggaaaatctgggacccggccgggcggaggccatcagtcccgcaggctcggcggcggagaaggggatccccttcacattccatcaggatgcgccggtgatccggcccgatatgctggagacggtgtggtgtgccgtgaaccgggtgacccggcagggccgcgtcctgggccgggaagagcgggtggacgtccggacggccctggaggcggtgacggtccacgctgcataccagtattttgaggagacggacaagggcaccctggcgccggggaagcaggcggatctggtgattctggaccgggaccccctggcggtgccgcaggaggagctccgggatattcgggtactggagacctggaaggatggcgttcccatcttctgccgggaggcatgagtctgccgccgggtggaaaagaacgcttgcaatttttcgcacgagaggtaaaataaggaggaacgacgtgcccaacgcgttggaacatgggaggtgagcaatatggagaaaaagagcaagctggtgctggccgttttacagggaagcgattccgacaacaccatccgtaacctgaatgagcgcggcttcatggtgacggtgctgagctccaccggcggctttttgaagaaaaagagcaccacggtgatgatcggcgtggaggaggatcggctggaagaggccctggacgtcctgcagaagtatgcgggacaccggaaggagaccgtgtaccagagcgtgaccatgccccacggggagatgtccgcggtgccgccggtacccatggaggtcatggccggcggtgcggcggtgttcatcgtgtcgctggacgatatccgcaaattctgaatccctgcgtctcaaatggcaaaaaagacctgcgcggcagctgccgtgcaggtcttttttgcgcatcgaagggaagctcgtcagccctgtcgggccgcctcctccgcgtcaaattttgcccggtcccggtcgatctgcttctgatagcggtccgcctcggaaaagacgcagccgcagtacttctgcatatagaaccccagctctcgggcccgctggttgccggcccggaagtttgaccggaagtcccggtagagaaattccaccccgtactgccgggcatacatctccgctgcggcggcgatggcctcgtgattctgataggtgctggccagcagggtggaggtgaaggcggtaaagccgtgctctgccgcatacttcgccgtgccctccagccggtgttcgtagcagtaggcgcagcggtggtcgatgtctcccgccacatggcggacaaagtccttcagaccgtagtcctcctgtacccggacctccataccgatggtgggggcatacgccagcaggcagtcccgccgggcctgatactccttccaggggtggatgttggggttgtaccaaaacgccaccggctcgatgccctcgctccgcagagggtcgatgcagctgagggaacaaggggcgcagcaggtgtgcagcaaaacgcgttccatgtcgaaaatgcctctctttggttctgagatggaaccagtatagcatagaagagagaaaaggccaagcccctttcccaaccaagtttcttaacgaaaaattaacagtctttcagaatattgccgattgaacatcccatggaaaaagtgtatgatgtcaactaatgtggtatcatgcggttagctgttgaaaactctgacgcaaccgttttcccagaaggaggaagcagagttgaaagttggacttgacgtaggatccaccaccatcaaatgcgtggtgctggacgatgcggataatctggtatacagtacatacgagcggcattacagccatattctggaaaagtcggaggagctgctgcgccgggtggcggatcagcacggcgcaaaagcggatctggccatctccggctctgccggcatgggcatggcggagagcgtgcaggtcccattcgtgcaggaggtgtttgccacccgcgtggcggccaacaagctggccccggggacggactgcatcatcgagctgggcggcgaggacgccaaaatcctgttcctcaccggcggcatggaggtgcggatgaacggctcctgcgccggcggcaccggcgccttcatcgaccagatggcgacgctgctgaaaatgagcgccgacgagatggacgccgccgcccagcgggcggagaagacgtacaccatcgcctcccgctgcggcgtgttcgccaagagcgatgtgcagcccctcatcaaccagggcgccaaggcggaggatatttccgccagcatctatcaggcggtggtgaaccagaccattgccgggctggcccagggccggcccatcaagggcaacgtcctgtacctgggtgggcccctgaccttctcccgagtcctgcgggagagctttgaccacaccctgggggtccagggcacctgtccggagaacagcctgctgtacgtggccctgggcgcagccttctattccgaccaggaattcgacctgaaccaggtggcggacgacctgcagaagcacggcgcggcggagacctaccgctccctgccgcccctgttcagcagccgtgaggagtatgaggcgttccggacccggcacgccaaggccacggtgccccaggtgcccttcggcgcggactacgccgccccggtgcacatcggcgtcgactccggctccactaccgtgaagctggtggtcatcgaccaggacgcccgcatcctcttctccgactaccggcccaatctgggcaacccggtgcccctcatccggcaggtgctgcaggagctctatgacgagcatccggccctccatgtggcgtccgtcaccaccaccggctacggagaggatctggcgaaaaacgccttccacgcggactacggcgtggtggagacggtggcccacttcaccgccgcccgccacttcctgcccaatgtggacttcatcatcgacatcggcggccaggacatgaaatgcttcaagatcgaggacggcgccatcagcaacatcttcctgaacgaggcatgctcctccggctgcggcagcttcctgcagaccttcgcccaggcgctggggtacgacgtgaaagagtttgcccagctgggcctgtttgccgagcggcctgtggacctgggcagccgctgcactgtgttcatgaactccagcgtgaagcaggcccagaaggacggcgccaccattgagaacatctctgccggcctctccatgtccgtggtgcgcaacgccatctacaaggtcatccgggcctcctctcccgaggagctgggccggaacatcgtggtccagggcggcaccttctacaacgaggcggtgctgcgggcttttgagaaggagatgggcgtagaggttatccggcccaatatcgctggcctcatgggcgcctacggcgccgccctgttcggccggggaaaggcccgggcggatcagaccagtacgcttttgaaccgtcaggagctggcggacttccgccaggagacggagagccgggtgtgcggcctgtgcggcaacaactgccagctgaccatcaacaccttcgccgacggggccaccttcatcagcggcaaccgctgcgaccggcccgtcaccggcaaggcggacaccggggagcggaacctctacgaatacaagcgcaagctgatcctgggctacaagcccgtccccggcaggcggggcaagatcgggctgcccctgtgcctgaatatgtgggagctgctgcccttctggcacaccttcttcaccaagctgggcttcgcggtgtaccacagccccttctccagccgggacctgtatctgaaggggcagggcaccatccccagcgacaccgcctgcttccccgccaagttggcccacggtcatattcagttcctcgcaaagcttggcctggacgcgatcttctacccctgcatgacctacaatctggatgaggggctgggggacaaccactacaactgccctgtggtggcctactatccggaggtcatcgccggcaactgcccggaggttcagcagaccaagttcatctatgactatgtgggcctccaccggcccaaggacttcaccaaaaagatcttcaccatcctgcgcagctacttcccggacatcaccaagggcgaggtgaaggaggccaccgacgccgcctacgccgagtacgcccaccacatgtccctcatccgcaaggagggagagcggatcatcgaccaggcccgggcagagggccgccggatcatcgtgttggcaggccggccctatcacgtggacccggaggtcaaccacggcatcgacactctgattacccgcgccggcgccgcggtcatcacggaggactccatctccaaccgggtggagaaattccccaccacggtgctgaaccagtggacctaccacgcccgtctctacgcggcggcccgctactgctgcacccagcgggatatggacctggtgcagctggtctccttcggctgcggcgtggacgccatcacctccgacgagacacgggagatcctgcaggcgggcggcaagctgtacacccagctgaagatcgacgagatcaccaacctgggcgctgtccgcatccggctgcggagcctgttcgctgccctggatgagcaggacgaggcccgggaaactgccagaaaggaggcgtgagacatggagctggaattccagaattaccccaagttcacccctgaaatgaaaaagacccataagatcctgattcccaacatggccccggtgcagttccgcatcctggcggccgtcatgcggcaggccggctacacctgcgagctgctggagaactgcggcagccaggtcagcgagctgggattgaaatacgtccacaacgacacctgctatcccgccctgctggtcatcggccagttcctggacgccctgggctccgggaagtacgatctggaccacaccgccctgattatcacccagactggcggcggctgccgggcctccaactacatccacctgctgcgcaaggccctggtgaaggcaggctatggccaggttccggtggtgagcctgaacttctccggattggagaaggactccggcttccccatgaccctgcccctgatgcgcaagcttctggcctgcatctactacggcgacctgctggtggccctgaaggcccagacggagccctatgagacccacaagggggacgcggccgctttgcaggagaagtggctggacaccatctgcggctgggtcatggaggacaagggctggtccggccgggagatcaaggccgccatgcccaagatcgccgcagagttcgccgccattcccgttcaccgggtacccaaggtgaaggtgggcgtggtaggggagatctacgtgaaatactccccctgggcaacaatgacctggagaagttcctggcctcccaggactgcgaggtgaacctgccgggcctgatgggctttgtgcagtactgcgcctacaacccctccgaaaccgcccggctgtatggcggcaccttcctggaaaagcatgtgtcaagcgtaatcctggactacatcgagggcatggagaaggtgatgatccgggtcctgaaggacaacggcttccacgcgcccctgcccttccgggagctggtgaagctgacggacggcgtcatctccaccggcaacaaaatgggtgagggctggctcctcaccgccgagatgatcgagctggtgcgggccgggtacgagaacatcgtctgtgcccagcccttcggctgcctgcccaaccacatctgcggcaaggggatgatcaacaagatccgggagctgtacccccaggccaacatcacccccatcgactacgatcccagcgccacccgggtgaatcaggagaaccgcatcaagctgatgctggcggtggcccgggagcggctggcggagaagactgccgaccagagtgcccgggagactccggcgcccgcagagaccccgcagagcggggcggagcctcagacagtctccgtataaacaaagccataactggaagtgccggcgcggcagacccgagagggtctgccgcgctgctgttttctggccgtgctcccagcatttgtgccttgaggcccgcagcccgttccggtaaaatagggcgtgacgacacacgcattttggtgacgattatctgaaaaaggagcgttttcccttgcgaaatttcatcagacgaaccgccgccgcgctggccgtcctgtgtatggcggccctgctgttgggtacccccacggaggcggaagagcgtacatattccgccggaggagaggcggtgggctactacgccggatgggcggcctaccagggcttcacccctgaccaaatcccggcggagcatctgactcagatcaactacgcctttgcccagatcgacccagataccctcaccattgctctggagaatccagcccatgaccaaaagaacctggccgccctgcggaagctgcgccagcagaaccagcatctcaagctgctgatctccgtgggcgggtggtcggactcccagtacttctccgacgcggtcgccacggcggcccggcgggagagcttcgctgccagctgtgtggactttgtggtggagcagggcctggacggggtggacctggactgggagtacccggtatccggcggcgcggcggggaccatccaccgcccggcggacaagcagaacttcactctgctgcttcaggagctgcgggagcagctggatcggcagggccgccgggacgggaaggactacgccctcactatcgccggcgccgccgggagctggtacttaaaccagatcgaggccgtgaaggtggccgccattgtggaccacatcttcgtgatgggctatgacctccacggcacctgggatacctacgcggacttcaacgcacccctgtatgcgccctccggcacctcgccccagagcagaagcagcatctccgattgcgtacaggcctatctgaaaaagggtatcccggcggaaaagatcgtcctggggatgcctttgtacggctatgcctaccagggggtcaaggcccagaacaacggcctgtacagcacttacacatcagccaaatccgtcagctacaagatgctgaagaagagctatctggacaacacggactaccgccagttccgccatgaagaggcgcaggtgccctggctctacggaaaccgcaccttcgtctcctacgacgatgccgtgtccctcgctgccaaggcacagctggcccggtctctgggtctgggcggcgtggggttctgggagatctcccaggacgatgggggagagctgatcgctgccgccagcggggccttccgcagcacctgggacaatcccttccgggacgtaccccccggcgcgtggtatgaagaggcggtccaatatgtgtatgaggcggggctgatgcaggggaccaccggcagcaccttttcccctgaccgggcatccaaccggggcatgatcgccgccatcctctaccgactggagggcagacccagggcggggacgcctcccttcaccgatgtggcggcggacagctactgcgccgatgcggtggcctgggcggaacagcagggaatcgtccggggctttgacgacggaaccttccgcccggaggggcggatcacccgccagcaactggcggccatcctgttccggtacacggaatacagaggagcggataccgcgggccggacggacctgagccgcttctccgacagcgccgctgtggcggactatgcccgggatgccctggcctgggcggtgtctgctggactgctccagggccggtccgacggcacgctggatccgtccggctccgccacccgggcccagacggcagtgatcctccagcggctggaaacactgctggaaaagaactgaacagagtgccgcagggccgggacacactgtcccggccctgcatgtgtcctctccttgacggaccgtcccgttccaggtatgatggaaccaacaagattggccggcagagaaggggagcgattcgatgaaggtgtgcattctgatgggcagccccagaaaacagggcaataccaacgccctgctgggccccttccggcaggagctggaagggctgggggcggagacggaaactgtatggctccatgctctggagatcaggccctgcacggcctgccgggcctgccagcgggactggacggcatttggttgcgctcagcgggacgacgtgcccatgatctttgacaaggtgctggcgtgcgacctgatcgtgttggccacgcccatctattcctggtactgcacgccgcccatgaaggcattgctggaccggctggtgtacggcatggacaagtattacggggcggaaaaaggtcccgccctgtgggcggggaaagccctggctctgctgctgacctgcggctaccgcccggagcggggctgcgacctgttcgaggaggggatgcgccggtactgcaagcacgcccagctccgttttctgggcagccacgcggagcggcacctggggtatgacgtccccttcatggacgcggagaaagaggcccgcacccgggcctttgcccgggagctgtgggatgccgtgcattgaagcacagcccctgtgagaccgccgcccggcggtctctttttctgcgcatgggcgggataaaaccgccccaaacggttgacggacacggtcccaaggcggtataataacatgatttacaatggataagagtttgtctggaggaattttggtatgtggatcgcggagcaatggcaggactatgagctgctggactgcggcgggggagagaagctggagcgctggggagagcagtacctagtgcggccggacccccaggccatctgggacagcccccggaagaaccccgcctggaagcgggccaacgcccggtatctccgcagccagtccggcggcggccactgggagaagaagaccctgccggagagctggaagatccgctaccgggacctgaccttccaggtgaagcccatgaacttcaagcacacgggcctgtttccggaacaggcggtgaactgggatttcgccatggagaagatccggaacgccgggcggcccatccgggtgctgaacctgttcgcctacaccggcggggccacggtggcctgcgccaaggcgggggccagcgtctgccacgtggacgcggccaagggcatggtggcgtgggccagggaaaacgccagactctccggcctggaagacgcccccatccgctggatcgtggacgactgcggcaagtttgtggagcgggagatccgccggggtaagacctacgacgccatcatcatggacccgcccagctacggccggggccccggcggcgaggtgtggaagctggaggacaacctctacgacttcgtgaagctctgcgccggcgtgctgtcggagcggcccctgttcgtgctcatcaactcctacaccacgggcctggccccgtcggtgctggggtatctgctgcatctgttggtgggggccaaatacggcggcaagtgcacctgggacgagctgggcctgccggtgacggagacgggcctggctctgccctgcggtgccacaggccgctggtgcagcgagtgaggccgtgggacggactgcggcatacctgctgacgctggcagcgggggcggtgcctgccctggcgctctttgggtgcctgagcccccggcgccggcggcacctcgccgccgcgggccttgccagtccggtggtccgggaggcggggatggccctcttctggatgttctgcggcggcatggccctggtgaccctgacgccccgatgggtcgtccaggccctggcgggcctgcttcagggctgcggctggaacggggaggggaatcccttcttcgctccggggactgtcaatctggttcccttccggaccctgggcgacggttacatcctggcggggaatctgatcatgttcctgccctttggctttttccccgccctgctgtggcgggggtgcacgtggaaacgcgcgctcgccgcgggcctgtgtgtcacggggttcattgagtgctggcagctgctggtgggccgggcctttgacatcgacgacctgtggctcaacaccctggggccttttgcggcttctggagctggtgcctgctggaccgggcagcccccggctggacccggcggttcagggtccggcaaatacaagactgacgaaatgaggacagctatggcggagatcatccgaacggagaatttacagtacgcctacccggcggacgagggagcggagccggttctggccctgaagggcgtggacctgaccattgagcagggctccttcgtggtggtgctgggccacaacggatccggcaagtccaccctggccaagacgctcaacggtgttctgctgccctgcgggggccatgtgtacgtggagggaatggacaccctggacgaacatctgctgctggccatccgccggacggtgggcatggtgttccagaacccggacaaccagatcgtggccaacgtggtggaggaggacgtggccttcgccccggagaacctgggggtttccagcagggagatccggcagcgggtggacgacgccctggcggcggtgggcatgggcgagttcgcccgccacgcgccccatctgctctccggcggccagaagcagcggatcgccattgccggcgtgctggctatggagccggaatgcatcgtgctggatgaggccaccgctatgctggacccggtgggccggcgggaggtgctctccgccgttcacaggctgaaccgggagaagggcatcactgtggtgctcatcacccaccacatgaacgaggcggaggacgccgaccgggttgtggtcatggacgacggaaaagtcattatggacggcgcgccccggcaggtcttcacacaggtggagcggctgcggtccatgggactgacggtgccggacacggtggacctgctggaccggctgcgcaaagacgggctggacgtgcccctcaccgccctgacggtggaggagtgcgcggacgccatcctggccgccgtttccaagtaatcggaagggaagagaacattggaaccgatactgcaagtacaacatctgacccacacgtacagcgtgggcacgcccttccagcgcagcgcggtggaggacatgagctttgacgtgtacgatggggagttcttagggatcatcggccacaccggctccggcaaatccaccctgattcagcatctgaacggcctgttgcggcctacgtcggggcagatcctgctccatgggaaggacatctgggcggagccgaagaagatccgggacgtccgcttccaggtggggctggtgttccagtacccggagtaccagctgtttgaggagacggtgtacaaggacatcgccttcggccccatcaaccagggcaagaccggggaggagctggaccgctgtgtccgggaggccgcccgcctggtgggcatccgggacgatcagctggacaagtccccctttgagctctccggcggccagaagcgccgggtggccctggcgggggtcatggctatggacccccaggtgctggtgctggacgagcccaccgccggactggatccggcgggccgggagaacctgatggccaacatccgggactaccaccgcaataaaaagcgcaccatcatcctggtgagccacagcatggacgagatcgcccggaatgtagaccgaatcctggtgctgaagtccgctcacgtgctgatgagcgggactccggcggaggtgttcgcccgggcggaggagctgctctctgccgggctggacgtgccacaggtgacccgtattgccatgcgcctgcgggagcagggcctcgccatcgaccctgcggtctacaccgtggaggccctggagcgggagctgctggcgctgagaagggggagacgggatgctgaaggacatcaccctgggccagtttttccccggcgacaccgtggcccaccgcctggacccccggacgaagatcctgctggtggtcctttacatcgtggcgctgttctgcgccaagagcctgctggcctacggcattctggcggcggtgctggcagtgtgtgtccgcatctcccgagtagggatcaaatccctggtgcgggggctgaagccggtggtgttcatcatcgtgttcaccggcattttgaacctgttcttcacgccgggagagcacatcctggcagagctgggcttcctgcggatctccgcggagggtctgcagaacgccgtgttcatggtgctgcggatcatgctgttgatcatgggcacgttcctgatgacctacaccaccagccccatcagcctcaccgacgggctggagcgcctgctgggcggattgaaaaaaatccatgtgccggtccatgagctggccatgattatgtccatcgccctgcggttcatcccaaccctgattgaggagacagacaagatcatgtccgctcagaaggcccggggcgcggactttgagagcgggaatatcatccagaaggccaaggccctgatccccattctggtgccgctgttcatcagcgccttccgccgggcggacgagctggcggtggccatggagtgccgctgctaccacggcggcgagggacgcaccaagctccatgtgctgcagtacgaggggcgggactatctggccctggcgctggggctggccgtcaccgcggggatcatcgtcctgcggcaatttacgtaacgatttgccggtccacggactggctgcccagggtgaggcccagccgcaggccgatggcaaaggcagccgtgccccagcggagatagcggctggagaggagatcacagacctggatctgcatgtcctgcggcatggacatccggtccagcgccgcctggatttccgcctcatcatagggcgcctgctcctgcatcagatggtcgccgtaggtatcgaacagaagctcaaaaacggatggcataggagacactcctttgcgaatacagctttttatggtatcatttcggaatgatgaaaccagtataatacagaaatttctgtaagtcaacagaacgatcagaaaaaactgtattttaagaaagggaatggtcctttggatgttttgactacctcagccagaattaaggcccgctgcaaagcgcagaaaatttcagtcaaaaatttgctggagcagacacagatcaaccggaattttatctatgacctggaaaaaggcggacagattccgtcagcggaaaagctggaacgcatcgctgactatctggactgctctgtggactatctgctggggcggacagacaacccggcggtcaaccgctgaccggcctcaccggaagaggattttctccggggggaatgtaggggagacagtctgccgtccggctgccccgcattttcaatcgcccggagctggtaatcatcgagatccgtccggacgcatgactggaaatcatggatagtggacatggcctgattcggagcggctgtgttttggcagagaggggagagtcctatgaagaagcagaacatctggctttgggccctgactgcggctgtggttttgctggcagcagccctggcggagacgcaaggacagctgggggaacttcagacggcgtattccgcgctccaacaggaggtgggagaactccgcctggacttgaaaagcacacaaaaccgcctccaggagcaggaggaggcgctggaacgagcggccgcccaaaccgccccgcagccggaggagtcgctgctggagcgctatgagctgacgccccttcggctggacgccgcggcccatcaggtggagcttggggtgtccctgaccctgactacgccggaccagtcggcggaagccaccctgaatgtctatcagggcggcgcggagcgcaagcgtctggcccaggtggagctgacccggtccggggatggaatcttctccggtcaggcggcggtgcctgcggacagcacctcactccagattctggtgacggtccggaccggcggcgatacggccacagagcggctctatgagggccgtgccaccggattgttgccgatggcgctgtccagccgcagcggagaggcggccctgcaggaaggagaagcccggattaccgccgccgtccggctgcgtgaaaaggcggccgcagcctccgagcagacattccgcctgtaccggaacggtcagttggaggagaccatcccggccgcctccggccaggaatccggcacctgggagggcaccgggacggtatcctgcgccgccggggaccagctggaggtgcggttcttctgcgtggacggcctgggcctgggatatgagttccctgtccggacctggacggtaaaggaggaccggctggcgccgggctggcccgtcaccaacaccccggtgctggtctggccgtaaacgggacggggcgctggcggaagaggcgcaggacggcaggagattccggccgccccggaaggcttatccccggatacatgaactgcggcgccgcacaggggagtccgtcagatccgtagacggcgaccggagcaatcctgcatcagcgagaggcccagccccaggccgatggcgaaggcagctgtgccccagcggagatagcagctggagaggagatcacagacctggatctgcatgtcctgcggcatggacatccggtccagcgccgccaggatttccgcctcatcatagggcgcatactcttgcatcaggctgtcgccgtaggtgtcgaacagagtttccgaaatgcttgtcatggggattcctccttaatatgtgttgttccgatatcctttttgtggtatggtatttcttatttatacgctaaacggattttatcatgtaatagcgtgattatcaagatgcttttcacgttttttcgtgattttagagctttacaaaaggcggggcaaattttatgtatgttacacaagacattgcagaccgcattaaatggcgcctcaaagaaaaaggcatccgcacaaaagatatgctgtctgatttgaacatgggaattaacgcgatatcagaatttgcaaaaggcaagcaaatgtcctgtattgcccttgctcgcatcgccgactatctggactgctctgtggattatctgctggggcggacagacaacccggcggtcaaccgctgagttgccctgccggataaaaagagcgttcccgccgggaaccccgggcggcggaactgccaaaggagagcttatgcgcaacattgccctgaaactcatgtacaacggcaccgcctaccacgggtggcaggtgcagaagaacgcggtcaccgtctgcgggaccctggagaaggccattgctgacatctgcggcggcccggtacacctcaccggctgcggacgcaccgacgccggtgtccacgcggagcactacatcgccaacttccgcacggagagccgcattcccgtggaccggctccccttcgccgtcaacacccacacgccggaggacatcgcggtgaaggaggccttcgaggtggcggaggacttcaacgccatcggctcctgcatcaagaaggagtacacctaccgcatctacaactcccggttcaagaacccattttacgtcaaccgggcctacttctatcccaagcacctggacgaggaattcctgaaccgggcagcggggatgttcgtgggcacccacgacttcgcggcggtgcgttccgtgggcacggagacgaagtccactgtccgcaccatctattactgtgacgtgacccggaacggagatctgctggaattgaaggtctgcgccaacggctttttgtataacatggtacgggccatcaccggcaccgtgctgtacgcggcggagggcaagttcaccccggaggacatccccggcattctggagcggggggaccgcaccgccgccggtcccacggtgccgccgggggactgtacctgacaagactttggtatgaggatgaacggctcaatggctgatacgacgaacgacatctggaacgacaacgacggggaagaggacgaggctccccggaagggcggacggctgcgccgctttgggatcttctttctggtgctggcggcggtgctgggcgtggtgctcgtggccgcgtaccgggacggcaccggctttgacgccctgcggcggctgtgttcctacggcagcggagaggagagcactgctgaggcccagtacgactacgacgcctccgacagcaaccgctttgccgtcctgggggattccctggtggtgctctccgacacaaagctgcaggtcctggcgcggggcggagaggagatctggtccacatccgtgcggatgagcgcccctgccctggagacgggcggcggccgggctgtggcttacgacgtggggggcacagagctgtatgtggtggacgaggggggcgagatcctcacgctcaccgcaccggaggacgccccctatttctccgcccggctgaatgaagacggttggctggctgtgaccacagaactgccgggctacaagggcggcgtcaccgcttataacagccaggggacggaggtgttttcactcaccgcgtcggaccggtttgtcatcgacgcccgggtgacagatgacgataacactctggcggtggtgaccttaggccaggagaacagcgtgttcgtcagcaacatggtactttacagcctggagacggcaggaaatgtagacccggcggccgactacgatgtgaccgacggtctggtggctgccgtcggagagcaggacggccagctggtgacggtgtccgacacctgcctgacctacgcgtccccggccggggaggtgcgcgctacctactcctatgccggcagctatctgcgggaatacgacttgcacggggacggcttcaccgccctgctgctgaaccggtacaagtccggcggtgtgggccggttggtgacggtggacacggacgggcaggagatcgccgccctggacgtgaacgaggagatcctcagcatctccgctgccggacggtatctggcggtgctgtatatggacagcgtggtgatctacacagaggagctggagatctatgctcagctggagggcacggactacgcccggtcggttctgatgcgccaggatggctctgccctgctgctggcggcagagagcgcccacctgttcctgccttgagtgggaaacattgatcttggaattcacaaaacgtttacgagcaaaaaggtaggcaagcatgacaacacctgttataatagacgtgattatggctgtggttttgatcgctgcggtcatctacggtgcccacaggggccttttccgggccctggcgggattggcggtggtgatcgtggccctggtgggggcggccatcatcgcaaataccctggccgccccggcggcccgtctggtgacgcccctgatccgggagcaaatcgagacgaaggtggacgaggctatggcccggcagtcccaggaggtccagatgccggaggaggacgtggacgagggcttcgccatcgaggacctgctggccctgatgggactggacgaggacgtgcggaactccctggccagccagacgcaggagaagatccaggacaccggcgtctccttggtcatggccgtggtggagagtctggcccagtccattctctatgcggcgctgttcctggtctccttcgtgggactgacgatcctgctgaagctgctgatccgggctatggacttggtgctgcagctgccggggctgcacctggtcaacgccctgggcggcgccgtgatcggcctgatcgagggggccttggtgctgtttctggccatctgggttctgcggcgcttcggcgtctcctttgagacagacaccgtctcagccacccatattttacgattttttgcgacacacacgcccctgagcgcgctgtcgcttctgcaatgacgaacggggccgttgccccgccggcgtcacgatttctggagggatttacacgatgcagccgacactttgttcaagatgcaagaagaacgtggccgttgtcttcatctccaaaatggagggggacaagaccaccaacgagggcctgtgcctgaaatgcgccaaggagctgggcctgccccaggtggacgatatgatgaagcgcatgggcatttccgacgaggatctggacacgctcaacagtgagatgctccaggccatgagcggcgtggagaatatcgaggacctgcccggcggcgaggacgccggggaagaggaggaagagggcaagaccgccaccttccccttcctgaaccgcctgttctccggcgaggccgccaagggcggcgagagcggcggccaggaggaaagcggtgcccgaagccgggaaaaggagcgcaaggaccctaagaacggcaagcgcaaatatctggagaactactgcatctccctgacgcagcgggcccaggagggaaagctggacccggtgatcggccgggagcaggagatcgagcgggtggtgcagatcctgaaccgccgccagaagaacaacccctgcctgatcggtgagcccggtgtgggtaagaccgccatcgcggaggggctggcccagcggatctccaagggcgacgtgcccttcaagctgcggaacaaggaggtctacctgctggatctgacagctctggtggccggcacccagttccggggccagttcgagagccggatgaagggccttatcgacgaggtgaagcgcctggggaacattattttgatgatcgacgaggttcacaacattgtgggcgccggcgacgccgagggcagcatgaacgccgccaacatcctgaaacccgccctctcccggggcgagatccaggtgattggcgccaccaccttcaacgagtaccgcaagtccatcgagaaggacaccgctctggagcggcggttccagccggtgacggtgaacgagccctccattgaggactctgtgcagattctccagggcctggccccaagtatgagcagtaccacggggtgaagatctctgaggggatcctgcgtcaggcggtgctgctcagtgagcggtacatcaccgaccggttcctgccggacaaggccatcgacctgatcgacgaggcatgttccgacctgaatctgaaagacccggatatctcccgccgcatggagattcagcgggagctggacgactatgagaaagagcgcaccatgctggaggagcaggaggagaaggccgagggcgactacgcccgcatggcggagctgaagagcaaggaactccagctgaacacagagctgaacagtctgctggaaaagggcgatccacagctctccatggagaatctggcccatgttatcgagctgtggaccaaaatcccggcggccaagatccgggagcaggagttccagcgcctgagccagctggaagtgcggctcaagagccatatcatcggccaggacgaggccgtgtccgccgtagccgccgcggtgcggcggaaccgggtgggcatctcccccaagcacaagcctgtcagcttcatctttgtggggcccaccggcgtgggcaagacagagctggtgaagcagctggcaacagacctcttcaacacgccggatgccttgatccggctggatatgtcggagttcatggagaagcactccgtctcccgtctggtgggctcccctccgggctacgtggggtatgacgaggcgggccagctgacagagaagatccgccgcaagccctacgccgtggtcctcttcgacgagattgagaaggcccatcccgatgtgctgaacatccttctccagatcctggatgacggcgagatcaccgacgcccacggccgcaaggtgaactttgagaataccatcatcgtcatgacctccaacgccggcagcgccaccaaggagggcaccgtgggcttcggccgctccgtgaacgagcaggacgccgaccgggccatgaaggcgctccagcagttcctgcggccggagttcatcaaccgggtggacgcggtcatcaccttcaaccgcctcagcgaggagaacttccacggcatcgcacgtatcatgctgaacgaactggtgggttccctgaaggagaaaggcatcaccttcatctacgacgacgcactggtggagcttttgacgaagaagtcctactccctgacctacggcgcccggaacctgcggcgcaccatccagaaggagctggaggaccccatggccacaaagatcatcgacagctacgagcatcccatcacccaggtgaaggccacggtggaggacggtgccattcggctgtacaccctgtgaccggaggaagaggagagggaggaccatgctgtttcggaaggatatggatccccgctgtgcctactgccagcggggccagcagatcaacgagcgggaggtggcctgcgtcaagcggggcatcgtggcggtggagcaccactgccgggcattcaaatacgaccccttgaagcgggtgccgccccggccggcagcgctggagactgaacggctgaaagaggaagatttttcgctgtaagcagcgttcagcacccgcctggggaaaatccccgggcgggcgctgtcacaaatgggaaggagaggagacatcatggaagtcaagcggatctgcgcggcgtactggagcgccacaggcaacacagacaagacggtgaacaccatcgcggagaccctggcggagaagctgggcgtccctctggagcggaggaacttcacacgcccgtcagaccgggcggaggatctgtcttttacggggagagacctggtggtgttcggtatgcccacctatgcgggaaagctgcccaacaagatgctgccctatgtccagcagcagatccacgggaacggcgccctggcggtgggggtggtcaccttcggcaaccggtcctacgacaactccctggcggagctgtgcgccgcgctggaggcggacggcttccacaccgtggccgggggcgcctttgcctgccgccacgcctttacggacgcgctggcggacggccgcccggactgggatgacaagcggcagatgggggagttcgcggcccgcattgcggacaaggtaaaagacctgacggacatccctgctccggtggccgtgccgggcgatgcggcggcgccctactacgtgcccaagggcacggacggccagcccgtcaagttcctgaaggccaagccccagacggatttgggcaagtgtaccgactgcggcgcctgcgcccgcctgtgtcccatgggggccatcaatccctccaacgtggcggaggtgcccggcacctgcatcaagtgccagcggtgcgtccgcaagtgcacgaagcacgccaagtactttgatgacccggcctttttgtcccacgtggccatgctggagcagaacttcacagaacccaaggagaatgaggtgtatctgtgaggcggtgggttcttgcctttctgatggcggtcacagccaactgggtttctctgatctatgcgtttggcccggtgagctggctcttgacgacgatactgcttctggggagtttctctattttaatctgcggcccattgagaagagcggtgcgcctacaaagcggatctggtatttgaaaagcggctgcgaattgctgcgcctgtttttgattacagctacggtcacagtctttgtgcagatggtatggctgtggtgccagatttccatgataacgccggagaacagccttgccgctggaacagctgttgcaggtgcggcttttggtgttctctgggctgtcttgctggaggccatcgtcttctggaacggcatgatccgggtgtatctcacctccgtccagctggggctgaagcaccgggtgctggcggccctgtgcgggtggatccccattctcaacatctggtatctgcggaagattatccgcatcaccgccgacgaggcggagttcgagacggagaagtgggagctggacaccgcccgggcggagagcgagatctgtaagacgaaatacccgatccttctggtccacggggtgttcttccgggacttccgctatgtcaattactggggccgcattcccaaggagctccagcgcaacggcgcaacagtgtactacggacagcagcagtccgccgccgcggtggaggacagcgggcgggagctggcggaccgtatccggcagatcctggcggagaccggctgtgagaaggtgaacatcattgcccactccaagggggactggacagccgggccgccatcgcccacgctggatgtgccccctgtgtggccagcctcaccaccatcaacacgccccaccggggctgcatctttgccgaatatctgctgaagaagatccctgcagcggctcggcagaagatcgcagatacctacaacgccgccctgaagcggctgggggatgaggccccggacttcctggcggcggtgacagatctgaccgcctctgcctgcgaggccaggaacgcggctaccccggacgcccccggcgtcttttaccagagcgtcatgtcctattgcagaaaggcccagcacggcaagttccctctaaacatgacctatcctatcgtcaagcactttgatggattgaacgacgggctggtggcggtggactccgccaaatggggcgatcagttcaccctgctggagccaagggggcaccggggcatctcacacggggatgtggtggatctgaatcgggagaacattcccggcttcgacgtccgggagttctatgtctccctggtagcggatctgaaaaacagaggcttttgagcggaaaaaagcggagcgtcacagggacgctccgctttcgtgttccgtggtgtcttttatggtgggggccaccggttccacaaggggatccgccgccccgccatcctctgtggtgtcatctgcgggggaacaataggttttgtacagcgccacatggtcgtagatggcccgccaggagctgtaagcgtctgccgtcacacagatatagcgtctgccgtccgctgtttcgccgcagctggcggcgcagttgccggactccaccacatagccggtcttggcgccggtgacctcaatgccgccggtatccttgtcctcgatccgccgcaggaaccaattggagaggatctgcccctccgggtggtccgcagtggggagagtctcataggtccgggcccccagcacctcccggcacaggtcgttgtccatggccgcctccaggatcaccgccatgtcggagaccgtgcacttgtgggcctcgtcatacagtcccacgcagttggtgaagtgggcggtgtccgcgatgccaagctcctccagcttttcgttcatcagcgccacgaacgcctcctgggagcccgccacataagtggccagccccagcgccgcgtccgcaccggaggagaggatggtgccgtagaacaactcacgcaccgggaccgtttcgtcaaccatcagccccaccacgctgcacccgttgacatagcagtagtcggtgatgtcgatggtcatggtgaaggtgtcgtccagctccgcttctgtgatgtgctcagcggccaccagaaccgtcaggaccttcgtcatggaggcgggagagatcacagtatccgcgtttttctccgccaggaccgtccgggtgtccaggtcaaccaggaccgcgcagcggctgggaaagtcctctcccagctggatcgtgtccgggccggacacggccctggcatagggctccggcgcaggggcgctggcgacggatgtcacctgaaagggccgttcggccttaaccatctccggcgcaggcttttcaatcagctgggctcccacggtcaccaggcctacacacagaacggccagcagcccgcagggcaccagacggcgaagcagccgccgccgcttttcccgctgcttctttcggcgggcctccgcccgctgggcccgccgggtggcccgctcctcgtccgtgataatgggcttgtactcctcgtccatatcggcgctcctatctgaaaggcgggcctgtccggcaccgccgcagtctcgtactcttcattataacagatgatggaagaaaatgcatctcctattttccggtttggcagagggaattttatccatccggcttttgacccgtgaaaaaccgctgtcaggccaagttgtttttgcatagcctgagtgtaagaacaacacttggaggggagcgtatggctcaagttacccattttttcgcaggcgctaacagcggtgacggcttccagaacctgttttcggagatcgtggacctggaagacacctatgacctgatggttttgaaaggcggccccggcgtgggcaaggccaccttcatgcgggagatcggccgaagcatggaggaggccggcacaccggtggagtacttatggtgttccggcgacccggattccctggacggcgtggtgctgccggagctccgctgcgccgtggtggatggtacgtcgcctcatgtggtggagccccggtaccctgcggcggtggaccggtatgtggacctggggcggttttacgacctcaccgccgccaaggccgcggcagaggaggtgaaggctcatacccgggcctacaaggccgcatatatccgggcctatcaccatctgaaggctgcccggcaggtggagctggatgcagtggcggcggtgcggaagaccttcgaccgggagaaggcggaccgccggacggcgggcattctctcacgggagctgcgccgccggggcggtgaggcggggaagaccacccgccgcttcctgggcagtattacccacaaggggtacatctggcggtttgacagtgtggacgccctgtgccccaaggtctatgagctggcggacagctgggagctggcaggggagatgcttgcccggctgcatcgggcggcggcggataacggctgggacaccatcgtctgctgcgcgccggaggagccggggcggatcgagcacctgctgatccccggactggggctggccttcgtcacctcccggcccggcatggagtacgggcagaagcccttccgccgggtgcggctggacgccatgacggaacctcagggcaaggcccggctgcggttccagacccggatggcggcactcctgcgggaggaaggggccgcggcgctgaaagacgccaaagccaaccacgataagctggaggcagtctacaacccctatgtggatttcgacggtgtccgaaccctggcggcgctggaggcggggcggcttctcagctggctgggttgaatcagatcaggatgcgggccccggcggtataccgccggggccttgccttatgcgaacagatgtgctacaatgctggaagcgaaaacaggggcaagacagccccagagggaacgggactatgaccaaggaagaagcactgaaaacctattacggctacgacgtcttccggggcggccaggaggcggtcatcgacgcgctgctctctgggcgggatgcgctggccatcatgcctaccggggcggggaagtccgtctgctaccaaatcccggccttgctgctgtcggggatcaccctggtggtctcgcctctggtgtccctgatgcgggaccaggtgacgcagctggtgcagatgggcatcccggcggcgtttctcaacagctccctaaccttccgccagtatctgctggccctggaccgggccagggcggggcggtacaagatcatctacgtggccccggagcggctggagaccgagggcttccaggcctttgtgcgggaggcagacatctccctggtggcggtggacgaggcccactgcatctcccagtggggccaggatttccggccctcctacctgaacatccccgcctttgtggagagcctgccccaccggcccccggtgggagccttcaccgccaccgccacgccggacgtgaaggcggacatccaccgcctgctggacctgcaggacccgctggagctgaccaccggctttgaccgggagaacctgtattttgaggtccagcagcctgcggacaagcgggcggcgctgctggagctggtgaagggccgccccggcaagtgcggcatcgtctactgtgccacccggaagaatgtggaggaggtgtgcgacttcctccgccagcggggggtagccgccgcccggtatcacgctggcctggccccagaggagcggcagaggaaccaggaggacttcctctacgaccgggtgcaggtgatggtggccaccaacgccttcggcatgggcatcgacaagtccgatgtccggtatgtcatccactacaatatgcccaaggacatggagagctactaccaggaggcgggccgggcgggccgggacggggcgccctccagctgcatcctgttgtacagtggccaggatgtgcggactaatgagtttctcatcacccacagcgagccccgggaggacttggatccccggacggccgagcagctgcgggagcgggacctgcagcggctgcggcagatgaccggctactgccggacacgccggtgtttgcggcagtatatcctgcactacttcggcgagcacgcgccggacacttgcagcgcctgctacaactgcctccataacttcgaagaggtggatgtcagccgggacgccaaggccatcgtggcctgcattgccaaaaccggacagcacttcggcgtgggtgtcatcgcggagaccctctgcggtgcggacacggagcgggtgcggaagtaccacatggaccgggaggatacctacggcgctttgggtcagctgacccagaaggaggtccaggagcgcatccgcttcctgctggaccagggcgtgctggagctgagtccggggcagtatccggtgctgcggctgacggagcgggcggaggacgtgatgtacggcgaatcgacgctccagatgaagacgctgcgggaggaccggtccgccccggcccgccgggcggcggccggggagctggagggggatgcggcggagctgttcggccgcctccgggccctgcgggcccagttggcccggcggcagggagtccccgcctacgtggtgttctcggacaagaccctgcgggagatggcgatttcccgcccccggaccacgacggagctgcgtgcggtcagcggcgtgggctccgccaaggcggagcggtacggccgggactttctgacggtgatccaggactttccgtcgtgacggagatcagaagagacaacaggcgctgccccatgcgggacagcgcctgtctgtgttttttcagttcagaaaatccttcagctttttgctgcggctggggtggcgcagtttccgcagggccttggcctcgatctggcggatgcgctcccgggtaacgttgaattccttgcccacttcctccagggtgcgggtgcggccgtcctcgatgccgaagcggagctttagaaccttttcctcccggggagtgagagtggagagaacatccatcagctgctccttcagcagggtgaagctggcggcttcgctgggctcactggccccctcgtcggggatgaagtcgcccaggtgggagtcctcctcctcaccgatgggggtctccagggagacgggctcctgggcaattttcaggatctcccggaccttctccaccggcattcccatctccgcgctgatctcattgggagacggatcatggcccagctcctgcaggagctggcggctgacccgaatcaccttgttgatggtctccaccatgtggacagggatgcggatggtgcgggcctggtcggcgatggcccgggtgatggcctgccggatccaccaggtagcgtaggtggagaacttgtagcccttggtgtagtcgaacttctccaccgccttgatcaggcccagattgccctcctggatcagatccaggaacagcatgcccctgcccacgtaccgcttggcgatggacaccaccaggcggaggttggcctccgccagcttctgcttggcggtctcacccttggcgtgggcggacttccaggcggcgatctcctcctgggagtaggggatctcctgcccctccttccggagccggtcgatctccgccagcttccggtcggcctcgttgcccgcgcccatggcctgggccaggtcgatctcctcatccggggacaacaggggcaccttgccgatctctttcagatacatacggacaggatcgtcgatggagaagctgttcaccagagtgttgggatccaccagctcctcttcctccacatcggcgatctcctctgcggcgggctcgtcatccggcaggtccgccaacagggcatcgtcggcgctgatgtcgatgttcagcgcctccagggagtcgtagagctgatccatctgatcgctctccagattcaggtcatccaccgcgtccatcagatctgcggagtccaacttgcccttcttcttaccgcgggccagcagttcccgcagtttttcgttgttcatcagccaggaggctgcgggcagcgcagccacctgcttgtcgtccagccggaggatgccggccttccgggcctcctcgtccgtcatgacggcgggggcctcctgggccgtctcctccccctttttccgggtggactttttggcagactttgcagccggctccctctccgcggccttctccgccgcatctgcggccgccaggagcgcgtctgcctgtctcttcagctccttggggctcaactcaaactcatttgccatgctgctttcctccagtaccctttttgtctttgtatttttctgtggccgccagcagcgggtcggcagtcccgccccccagccgcttctcggcctccgtctgtacgatgcgtatgtagtccgccagcgcctgttgtccgtttcgcagagactccggctgctggcagacgccggtgagatggttcatctcctcctgggagaagaactccgcctgggccgccagggaggggacgcgtcctgccgccttggcctgccacagcgtggtaaaggcacggcccagcagtggggaggagaactgctcctcccgcaggggcggctcctccgggaacaggctctcgtcccggatcagcagccgcaggatgccctcctccgcccgggcggagcggatgttgtcgtatcgcagctcccgctccttgggctggagctggaccgccgggttcaggtcccgccgcagctcctgccgcttctcccgggagaggcggcgtttgaaggcccgctggacctccagcctcatgacctccggcgtgatcttggcggtctctgcggcccgggtggtgtagatctcccgctctaccggattggcaagtgcggccagcagggcgctgacctcctcacagtaggccacacgggcctcgtcactggagaggtcgtacttacccgccacctgggccatgcggaactcgatgccgttctcactgccggtcagcagcgcctcgaaggcgtcttttccctggagcttgatgaagtcgtcggcgtcctgctttaccagttcgccatcctccgtccgccgccggggcagctgaaggaccttgaccgaaaactccgagttgttcaggatctccagcgcccgctccgtggcgatcttgccggcgttgtcattgtcgtagcacagcaccagctccttcgtgaaccggctgaggagccgtgtctgctccactgtcaaagccgtccccatggaggccactgcgttgtcgaatcccgcttggtggagcgttaccacgtcgatgttgccctcgcagaggatgatgttggaccgcttggatttcttggccagattcagtccgtacagaacccgccgtttggagtacaccggtgtctcctgggagttcatgtacttgggctcagacttgtccaggacccggccgccgaaggccaccacgtctccccgcacatcgatgacaggaaagatgagccggttgcggaacttgtcgtacaggccgccgttccggttctgcaccgccaggcctgcctccagcagctccgacttcgtgtagcccttcttcgtcatggccaggatcagcgcgtcccaggcatccagagaggctcccagaccgaagttcactgccgtggccctgcgaattttccgccggtccagatattcctgcaccgcccgcccctccggctgttggagcatctgatagtagaaccgggccgcgtcccggttcaggtccagcagacgctggcgcctgcggcccgcctcccggtcgccgtcctcctccggcacctccatccccgcccgtttggccagaaagcgcaccgcatccgggaaggagagattctcctcctccatgatgaagttgataacgccgccgccccgcttgcagccgaagcagtagtagatctgtttgtccggagagacggagaaggagccggtcttctcactgtggaagggacacagaccaaagagattcgcgccctttcgggtcagctgcacatagctgcccaccacgtccacgatgtcactccgggccatcagctcgtccagaaagctctggggaaagggcatgtcaaggtctcctcctttcggtgagtgttgccagatttcccgagggtcatacccgaaagcgagggcgtacccaaaacgagacattttagatataccccgttcttttgggatttcctctttttttgctggattttttcaaaaagtttttgcctagtgggtttacagactgccgcggcctgcgtaaaatggtagaaaagcgtcgaagcggcggagaggaggcgtgagatgtccatcgagctttgggcggcccggttggagcgcccgctgacggagcgggagacggaggccatgctgcccctgctgcccccggagcggcaggagcggctgctgcggatcaagcagtcggaaaagcggcgggagcccctgtgcgcctatctcattctacgccatgccttgtgggagcagtaccgctggcgggagcttccgcctatccggctcacctctctgggcaagccctacttcccggatttcccagaggtccacttcaatctgagccacaccaccggcgcggtgctggtggccctgtccggggagccggtgggggtggatatcgagcacatccggccggtgagcgagcgggccatgcggcgtctggcggatgtgaccacggaacgggccttcttccagagctgggtccggcgggaggcccgggccaagcgcagcggcgccggcgtggggaccatgctggcgtcggagaccccgctccagcctggggagcgattctattttctggacacctttccgggctatgtggcgggagtggccacccgggacgggggcccgccaggccaggtgcgcaaatactccctggatgatatgatgggataaaagcgggggagaaaaaaggcggcggggcagtgccccgccgtctcccggtcggtttatacgatcttccgcaaaggcagcggctccgccgcatccttctgctccgcaaagtagcggatgatgtcttttcgggtgacgatcccggtgaagttccccaggtcgtccaccacagggatgaagttctggttcatggcgctgtggaggagctcttccatggtgacggtgatccggacgggaggatagctgttgccccgcagaatgtcccggacctgcagccgctccatgtccttcatggagtaggcagtcaaggtctcgcagtccttggacaggagctgccagaggaaatccccctcactgactgtaccgacatatttcccatcccggctgatgacggggatggcggtatagccgtggtgccgcatcttttccagtccctgacggaaggtgcagtcatcgtacagataggcgacgctgtgcttcgggagcagaaaataagctatgttcactttgctgcctcatttctaagggcgggggcccgcccgtattcggcctttccggccttctaaaaaaagtatacaggaaatgcctggggaattggtgaataatctatgaaatctgccggagaacggtctttactttttcgacagaggctgttattataaaatgtgatatatgcaacagaagggagcggccgcgatgttgaccccacaggaactgaaaaagagccccttgtttcaggacatcgggtacgagaattaccagcagatgctggactgctttcaggcggtgcagcggagctatcgggtggacgaggtgatctacgacttctccggcccggctggcaacgccgtaggcgtggtggagcggggggaggcatccctgatccgcatcgacgaggagggagtcgccactgtgctggaggagctgggccccggcggtgtgttcggcaagagcctggcgttttccacctccggccgggacagcttggaagtggtctgccgcacggcctgcgacgtggtgttcatcgactatccccatattctgaagcggtgtgagcgggcctgcacccatcatagcctgctggtgcagaatatgctgcggctgatctcagacaaggcccaggccctgtccgagcgggtggacgttctctcccgccggtccatccgggaaaagctcctgtgctacttcaaccagctggcggagaaggaggggagccggaccttccagctgcccttctccctgagtatgctggcggattacatcgccacggaccgcagcgccatgatgcgggagctgaagcgattgaaggaggagggcgtcctccggtccgaggggcggcgcatcaccctttgtacaggatgattgaccggccagaaggggcgctggaaagtttgttatttttttcgcagaatccccgcaaaaacggattgactgctttcgggggttgtgttaaagtatagacaatgtgtcgtgtcgaaggatacatcgccgcaaataccaaaattcgatcattcgggaaagaaggaacactatgtatcgtatcgtgagaaaagaggccctccgtcccaccgtcaccctgtatgagatcgaggcacccctggtcgccaagaaggcccagccgggccagttcatcatcctgcgcgtggatgagaacggcgagcgaatccccataacgatcaacgactataacccggagaagggcaccgtcaccatcatcgtccaaaccgtgggcgccaccacggaaaagctgagccgcatgaaagagggcgacagcctccaggactttgtgggccccctgggcaaggccaccgagaccgagggcaagaagaaggtctgcgtggtgggcggcggtgtcggctgcgccatcgcgtatcccgtgctgaagaagttccacgactgcggggccgaggtccacgccgtcatcggcttcaagaacaaggatctggtgatcctggaggatgagttccgggccgcaagcagcgtactgaaggtctgcaccgacgacggctcctatggccagaagggcgttgtcaccgaggcgctgaaggagctgattgacgctggcaaccagtatgatgaggtgttcgccatcggtcccatggtgatgatgaaatttgtttccaagaccacggagccctacggcatccccaccaccgtttccatgagccccatcatgattgacggcaccggcatgtgcggcggctgccgcctgagcgtgggcggcgagatgaagttcgcctgcgtggacggcccggatttcgacggccacaaggtggactgggatctggcggtcaagcggaaccagatgtatcgggactttgaggcccacaaatatgaggagacctgcaacctgttcaagaaggaggccgaataatcatggccaatatgtctttgaagaagaatcccatgccctctcaggagcccgatgtccgcaacaagaacttcgacgaggtggccctgggctatactgaggaaatggccatcgacgaggccaagcgctgcctgaactgcaagaaccccaagtgcgtgaacggctgccccgtgaacgtacatattcccgagttcatcgccaaggtggcggaaggcaagtttgacgaggccttcggcgtcatcacctccaccaacagcctgcccgccatctgcggccgtgtctgcccccaggagaaccagtgcgagggccagtgcatccggggcatcaagggtgagcccgtgggcatcggccgtctggagcggtttgtggcggactatcacaatacccacggccatcagggcggcgctcccgtcgtgccggagagcaacggccacaaggtagctgtggtaggctccggccctgcgggcctgacctgtgccggcgatctggcccggaaggggtatgacgtcaccgtgttcgaggcgctgcaccaggttggcggcgtgctggtgtacggcatcccggagttccgtctgcccaaggccattgtggccaaggaggtggcccggctggaacacttcggcgtgaagatcatgaccgataccgtggtgggccgcaccatcaccgtggacgagctgatggatgagatgggttttgaggccgtgttcatcggctccggcgccggcctgcctatgttcatgaacatccccggcgtcaactacaagggcgtgctgtccgccaacgagttcctgacccgcatcaacctgatgaaggcatacctgcccgattccgacacgcccctcatccatcccaagaaggtggccgtcgtaggcggcggcaacgtggccatggacgccgcccggtgcgccaagcgcctgggtgcagaggtctatgttgtgtaccgccgcggcatggaggagctgcccgcccgccgtgaagaggtggagcacgccgaggaggaaggcatcatcttcaagactctctgcaacccggtggaggtgctggcggacgagaacgacgatgtgaagggaatccgctgcatccggatggaactgggcgagcccgatgcctccggccgccgccgtcccatcgaggtccccggcagtgagttcgacgtggacgtggactgcgttattatggccctgggcaccagccccaaccccctgatcaagtccaccaccaagggcctggaaatcaacaagaagggcggcatcgtggtgaacgaggacggtctcacctcccgcgagaatgtctatgccggcggcgacgccgtcaccggtgctgccaccgtcatcctggccatgggcgccggcaagaccgcggctaaggccatcgacgaggcgttgagcaagaagtaagatctcccggactttttacaagacgggcagcgaaagctgcctgccttgtcccttttggttggaatctgtcggattagccttgacagcaggtgcggggaccgatacaatcaaggtgcctggttccctcaggtggagggcgccacgcggctttgggacagcgcggaggcgaacgcggcaaactgtgtcttggagggaaaaacgatggcttattgcagaaaatgtggtgcattgatcgatgactatgcggcggtctgcccgaaatgcggcacacctcagaacggaggaccgaataatcctccaccggcagcggacaacggcggcttcctgtgggggcttctgggctgctgtattcccattgcaggattgatcttgttcctggtatggaaggataccaagccccggactgccaaggcggcgggcatcggcgccctggtgtgcgtgatcgcctatgtactgatgtacgttgcggcggcggttctgggcatcagcgcagcggtgtatgcctattaagctgcggcgctggctttggcggtggcttccgattctcttcggatgccactgccggccggatcgctctttccattttcgggacggaacgccctttcccatctgcgcccggtgcaccggggagctggcgggcatcctggcggggctggcaacctggtgggcggtccatcccccggcgggagtggcggctgtgctgctggttccgttgattgcggacggacttctccagctctgtacgccctatgagagcggtaatctccggcggctggcgacggggctcctcttcggctacgggctgacggtgcttctgctcacgtccttgggctgggcctatcaatggggctttggctttgggaaaacattgctggatccctgagaagatcagcagccgtgacatccaggaggcaagaccatgctggaactgtgttttgatatgtcaacctgcggtgccctgcgggtggcccagcgctgcggcgggagcggacggaaaggcttcggattcgttctcagccgcacagaggacggcggaaatgtgacatctactacggtcatcggcttcgatgacggaaaagcgcccgcgggagaagagatccaccagatccagcgggcccagcggcggcaggcggccctggaacgggaggccatccccctgggcggcagtccgagtgatgtactggtcttgtccctgggactggatatgggggatatccgagaaccgctgggggcggaccggtgggacctgctgcgccggtggtgtgatggtgatgatgagaccacggaccgggactggcagcggaatttggaggcagcggagcgattgaggtcctgcggctctagggacgccgtccgtatttgggtggaccatacgccatacggcgcctgcggtctgctccacgctgccagcctgctgaaagacacaaaggccgacgtccgcgtggtgttcctgccgccctggcgggagcggccggacggcgtcgtggagacctacctgggttggggcgaggtggagccggagctgttcggacgcttcctgtcccgggaggagccgctgccgccggtgatgctgggcgctatggcccatcggtgggaggtgctccggcaggagaacgccccgctccgggcggtggtgaacggccgggtccgcagcgtgggggaggacttctacgacgaaatgatccgacgccatctgcccgagggccagacgaagatcgccaacatcattggagaggttctgggccgggagaagccgggcatcggcgacgtctggctggcggagcgcatccggcagatgctctccaccggggagctgcggatgctccgggaggaccgggagcggttttaccgctctgtggtagaaaggacttgacatttcccgggaaatctgtaaaataaaacatcaatataggtccgccgccgggcggacaaaggcgtttgcccctgcatccgtaggccattggagatgcggggcgcgggcgccttttattttttgctgtcagaggaggagtgatttgcatggcatgggtatttctggcatgcgcgggacttctggaggtgttctggtcctcgttcctgaaactgtccgatggcttcacgaagctgggctggtccgtgatgaccattgcggggatgctggccagcttctatttgctgagccaggccatgaagacgcttcccctgggcactgcctacgccgtctggaccggcatcggggccgtaggctccgtggcggtgggcatcctgatcttcaaggagccggtgaccgccgcccggatgtttttcaccgtgttgctgctgacgggcattgtcggcatcaagctgacctctccccactgagggaaaacagaaaacgaggaccggtccggtcctcgtttttccatagatgccgttacaggtccaccaccgtcacatcgtggcccgtgtgggggagaaagacatgcagcaggtcctccgtccgcaggcggaggctggcgtcgttcttgcaggggtggcagccgaaccaggccgcgtcatggactgcccggtccatcaccagccggacccggcgctccgtgtcataggccaggcccagcacgctggcagagccgggggtgcagcggagcatggactccatcagctccggcggggcgaaggagaggcgggtggtgcccagttgggcgctgaggaccttggtctggaagggcttgccgccgggcatggtcagcaggtagaacgccgtcttctgccggttgcagagaaacaggttcttgcagatggagatgcccagcacctcgctgaccacatcgcagtcggcgatggtgtcggcggtctcgtgggccacccaagcataggggatgcgcagccggtccagcagggcaaaggtctccagctccacggcggcgcggccctctgccggggcggcggtgcggctctctgagatctccacggctcacacccccgccagcagcttttccccggcccggtagatgtcaccggcgcctacggtgaggatcaagtcgccgggccgggccgcctgccgcagagccgccgccgccttgtccagggtggagcagtacacagcgccggggatattgcggcacaggtccgccgaggagatgcccaaggtgttctgctcccgggcggcgaagatctccgccaggatggccacgtccgggattttcagctcttccacgaaccgctcgaacagcttggcggtgcgagagtaggtgtggggctggaaggccaccaccagccgttcataccccatttccttggcggtggtgaacagggcgtggagctcgtcggggtgatgggcgtagtcatcgtagacctccgccccatgataggtacccttgtgctcgaatcggcggccggcgccggtgaaggaggccaggcccgtctccaccgcatggcccggcaggcccagtgcccaggccgcagaggctgccgccagggcgttgagaacattgtggtggccgtagacgtggagctctacgcgggcgtatttctcgccgcggatcatcacgtcgaataccggcctgccgtccacctccgtcagattggcggcggtgcagtcggcggcatggtccaggccgaaggtgaagatgggatgctccagcccggccaccgcctccatggcgctggcgttgtccgcgttgacgatgacggaccccgccgggggcaccagctccgcaaaccggcggaaggagtgctggatgtcggccagatccttgaagaagtccaggtggtcctcctccacgttcaaaatcactgccacggtggggaagaagctgaggaagctgttgcagtactcacaggactccaggatgatggtgtccccctggcccacccggtagccggcgtggagcaggggcagggtgccgccgatcatcaccgtgggatccgcctccgccgccatgaagatgtgggtgcacatggaggtggtggtggttttgccgtgggtaccggccacgcacagcgcgttgggataccgctgcatgatggcaccccaggcctgggcccgctcgtacacggggataccccgggccacggcaccggcgatctccgggttgctgtcgtggacggcagcggtgcggaccaccagatcgcagtcccccaggttttcggcgttgtggccgatggccacggggatgcccaaggaccggaggtggcggaccgtgtcgctctccgtcatgtcggagccctggacatggaggcccatgccccgcagcacctccgccagggggcacatggacacgccgccgatgcccaccagatgggcccgcttgccggggacgatatagtcgcggatgggatggagattgttcatcatgaaaagactccttatctgaagcgcactgccagcgcgccgctgatgattctgtgggaataccatgaggttgcccaaaaacctgcaattccttaccaaatatttcattatagtatgagaagacggaaaatgcaaccagagaaatccagggccccgtttcaagatcagcggtggcggccccaattccgtcggcttcaccaaactgagcgcagccgtaagaggaaggtaatttgccgcatacctgtggcagctttgcgtaatttgccggtttggatacgtgccgcaggaatcaacaaatcttgcctgccgcaaaagaaagaagccaaaagccgcctgcacagtctgaacgcaaatgttaatatacgttgcttgcgaaaacaggctgtttctcgtacaatggcgttaaccagaaaggagttcattccctatgttatgtgaaaacatcaaagccatcagaaaatcaaaagggctatcgcaggaggaacttgcgatcaagctgaatgtggtgcggcagaccatctccaaatgggagcagggattgtctgttccggatgctgatatgctgatctccctgtcagaggcgtttgaaacacctgtgagcacgctgctcggagaacctgtcacagcggcgaaggctgatgacctgaaagcggtttccgaaaagctggagatcataaatttgcagctggcacaggggaaggagctgcggcgaaaaacagctcgctgcctgcttattggattgtgtacggccatcgtaattatttccgcagttttcatttactgcgggagtccttatctggggtggaattatcacgatccggaaaccgccgttgttggagtcgcttttcacgcatttgaatggctgtttgtcaggtttgcgccgatgctcttgataggagcaatccttgggattttcctgacacggaagaaggcatagagcgggcctgttttggggtgcaattcagttcccgaaattccagcctgaggggcggaaggcattgcttccacgcctggacaacatgggcagctgtgttccgcggggaaaacagctgcccacgtcttttgcccacgggtggaaacatgaccggctgtgaaggagcggagatccaggcatagtttcacccaaatgacagaagatttccttgttccgtgaaatcacgatcatacttcaaaaggcagaatccggtggcccctgccttgcggcgggtcgcttggtgtggtatcatcagagcagcgcgaggtacaggaggaatggaggaggcccatgatccgaagaatggggaagggcgacctggatgctgtggcggccatctggttggacgccaaccgggaagcccacgatttcatcccagcagcctattggctgggacattttgcagaggtcaggactgcgctggcccgggcggaggtctgggtctttgagacggaggcgcgggccgaaatttcaggcttcatcggacttctgggagactacatcgccggcatcttcgtccggagggaggcccggtccggcggcgtgggtcggcagctgttggaccacgtgaagaccagccgcgggcagctgcgcctgcaggtctaccggaaaaacctccgggcggcagccttctaccggcgggaggggttccgtgtcctggaggagggcgtggatcccgagactggggaagcggaacttcttatggagtggcgatgggacggcccgcagagctgatccgcgatacgcaaggagaatggacataagggaggtgggcacatgacaacggtaacgatccccgctccggtaggggagatcctgaaaacactggaggcggcggggtatggtgcatggtgcgtgggcggctgcgtccgggatgccctgctggaccggatgccgggggactgggatgtgaccacttccgcccggccggaggagactatggccctgtttgccggccgggctgtcccaactggtctgcgccacggcaccgtcaccgtaaagacggagcagggtggcgtggagatcactacactccggcgggatggtgcctatcgggaccaccggaggccggagaccgtgacgttcaccgactctctggaggaggatctgcggcgccgggacttcaccatcaacgcgatggcagcggacctgcaggggaccctgtacgaccctctgggcggccgggcagacctgacggcgaaggtcctgcggtgtgtgggagagccggaccgccggttcggcgaggatgccctccgcatcctgcggggactgcggttcgcggcggagctgggggtcactgtccatccggatacagcggtggccatccaccggaaccgggaattgctgagagccattgctccggagcggatctgggcggagctgaaaaagctggtgtccggaaaatgggccgcagaggtcctgcgggcctatccggatgtggctggcgtcttctggccggagattctgcccatggtggggtttgaccagcggaacggccaccattgttacgatgtgtgggagcacactctccatgccatggagaaagtaaaaccggagccggagctgcggctgaccatgctgcttcacgatattggaaagccaaattgctttacagtggatgggctgggctgcggacacttttacggccatccggcggagagcgcccgcatggcggaggccatgctgggtcgcctccgggccgagacggttctccgggagacggtggtgcagctggtggcttggcatgaccgcaacatcccacgcacccgcccgggcgtggctcgggcactgggggcactgggggagcgggacctgcggcgtctgctggatgtgaagcgagcggacaatctggctcaggccccggcgtaccgcttcctgcagggggagatcgacagggcggaatgcatcctggaccagctgctggtggagggcgcctgcgtatccctgcggcagctggcggtgaacgggcgggacctgctggccatgggactctccggccccgcggtgggacagactttgcgggaactgctgaacgctgtgctggatgactccctgcccaacgagcgtcacgcgctgttggccgctgtcagggatcgggcacaccgaagctgaaggcaacggaaaagagagaagccccggacacacacgtgtgcccggggcttttggtatgaactgggagaaggggaagcgctcagaacaggcgcagctgttccgccacccggcggcggccggtggtctcccggaccaccggctccggcagttcccgcaggaagggagagaactccggcgcggcggtgaggatcagttcctcccgggcccgggtgaggcccacaaagaagagccgccgctcctcttccgcatccgccgggcggccgggggactccaggggcatcgctccggcggagagacccgccaggaacaccgcagggaattccaaacccttggcaccgtggagcgtcatcaggcgcactgcgccggaggcccagtgtttgccggatgcccgccggaggtctgcctcctggcccaggaccagagcatcccagaggctgtcgaagtcctcgtggaataccgccgtgttccgcaggcgttccagggccggagaggtgccgtactgttcctcccactgttccaccagcttccggggtgtttccgtctggaccagagggagccagacctctgtccggtccagccagttttccagaatgccgtggccccggaccgcctcctgcagggccgccgagtccagcgtgcccatcttttggcagagcgtctgggccttctggatgagatctgccgggcagttccacagcagccggagggcggactccagcgccgcgttgtctgctggcaccaccagggaacggaggaagcccagcgccccccgaaccgccgggtcatccaggaagtcctcccgcccggtgacaagacagggaatatcgtcgtggcggaggcatttctccaccagctccagctgccggtgggtgcggcagagcaccgcaatatcggaaaaggcccgcaccgtccgctcgtggcccagggcctgggcctccagcatgtccacgccgccggtcatacggccgatctccttggcgatgaatacggcctcggagaagctgtccgctgcctggaccagtcgcacggcaggaccggcggggcagtggggagtcagtattcggcccccgccgggattatgaccgatcactgccaaggccgtatccagaatggccggagcagagcggtaattttctgttaggtgaatttcctttacaccaggatgctcctcttgaagccgctggaagcaccggcagtcggcgccccggaagccgtagatggactggtccgggtcgccgatgacgaacagctccccgctccggctctaggaccggaccagctggtactggatatcgttgatatcctgaaactcgtccaccagcacatggcggaagcaccgcagaccggtgacatcccgcttcagtccttcggtcagcaggtcgtcgaagtccagggcgcccaggtctcgcagccgggcctgataggcgtcgtacagctccgcgtccagaccggtatcctccggggacacgccgtttttcacccgggagacagactggagcagcgtttttccgccgccctttcggccggactcccgcagcacctgctccgcgatggtcagggcctcgccgggactgatgagccgcacgtcgccaagcagtttcagacagatggcgtggaaggtgccgatggtcatggccgccaccgcccgcttgccgcccagacgctgttccagccgggcgcgcatctctgccgccgcttgattggtgaaagtgacggcggtaatctctccggggcggacgccccgttcctccaccagccaggcgatccgggccaccagggtgcgggtcttgccggtgccggggcccgccgtcacagcggttaccggcgcggtggaggtgacggcctccagctgcgggggattcagcgcctccggctggggagcagccggggccgcttctggcgccaaaacgtgctgcagctcccggcggggcttggatttgcgcacaggcaggtccaggccaaacagagagatctgcccgctgaaccgggcgatctcaccgggggtcagcagggagatgacgccgtactccccgtcaaagcccgcccggcgctccacctgcccggcccgcaggcggcggatgccctccgccacgcaggggccggccgtgtgggcgatatcctccacaggcacctcccgcaggatggagaactccggccccagggcatggagcatctgctcgtacagcgcctgggtattcttcccagcggcggagactccggtggaggcggcgatcacctccggcaggggcgccaaactctcaaagggtttggcaccctcgggacgaaaccctgcaggacggtccgccagggcctccacccggtgctccacgccgatggtcagtttcttcccgcaaacggggcagacgccgcccagcgccgctgtctccgccggggtcaggcagacgccgcagttccggtggccatccaggtggtacttgccctcctcggggaagaactccaccgtgccctggaatccctctccggtgcggatggcccggaccagctccgggtaggtgaggccggtgtccagaagatccgcctcccggcccagcttggagggggaatgggcgtcggagtgggagaccagggtgagtccgtccagggcagagacccgccagttcatgggcggatcagaggagaggcccgtctccaccgcgtggatgtggccggtcagatccccgaagcactcctccatggtatcgaagccggagaaggcgccaaacagagcgaagtggggcgtccagatgtgagcggggatgaattccgcgtccgggcaggtgtccagggtcagctccagcaggtcccgactgtccagccccagaatgggccgtccgtcggagtggatgttgccgatggcctccagccgggcggagagctcgtccgccgcctccagagagggcagcaggatcaggttgtggactttccgggttctgccgtggcgcttgtagatgcagctgatctccccggtgataacgaaccggggcgcctcgcccggggcgacatccggcaggcgcaaatcctggcgcagggtatagacgccctctccggcgggcaccagctgctcccgcagctcggcgcgccaagcggggtgggtgaagtccccggtgcccaccattcggatgccctttcgccgggcccaccagtccaggtgggggagatctccgtccttactggtggcccgggaaaagcgggagtggatgtggaggtcggcaatgtacatggaagtcctcctctgtcgaatcaagtcgattccattataatctcttccatccgacagcgcaaggcggagaaaagcagcccggcgtgttccgccgggctgctgaaaaaatcatttatgggttttgcctgccggagggcatgcgcttcgggacgcgagccaggcgcgggaacactgcccggaacagggaggaggccaggatgaccccaaccgccagggcggccgccatgcccagagtgcccagcagggcgctgaggaattgctctgtgtcgccctccagacagtagcccatggcgtagtagatgccgccgccgggcaccaggggcagcagggccaccagctgatagccggtgacggggcagcggcggatacgtgccatgacttctgagaacagactgatggccatggcggcgaaaaagcctgccaggatggtcttgccggccagcagatacaccagccatcccagagcgccgccacagcaggcaatcagcttgccggggccatggatattgaacaccagagtgaatccgatacagccggcgaaagcacacaggcagggcagaacatattgagaccagatatccataaaagtagatcccctttacagaatatacccgatgcccaggcccacagcggcccccagagcgatacccgtggcgatcagaatagcctccgccgtccggctgagtccggagtaggtgtcgccggccacgatctcccgcatggcgttggtcagggccacgccgggcaccagcagcatcaggacgccgatggtcaccaggtccacattattccccaggcccgcccgcaccagcagaagagacagcagggaggcgatgccgctgcataccagcgtccgcagaaagctgttgctgcccagccatctgccgccaaagagcaggcaggtgcccaccaccagaccgcagaagaaggcgctcaagctgtcccaaaacccgccgccgaacaggggacagaagaaagcgggggcgataccgtagcccagcagcaccgtggcggggcggtggcggcggcaggaggcagggaggcggtccaccatggcccgggcctcgtccaggggcggtacggtacggcagagctggcggcataaagcgttgcagctctccagtagctccagatccgtgccgtgggcactgatccggcgcatccgggtcaccggacggccatcctccgccatcaaactgacaatcaaacagctggggatggcaaacacctgggcgtccttgccttggtaggcctgcagcagccggtagacggactcctccacacgggagatttccgcgccgctctctgccagcaggcagcccagcgatgtggctagattcaacagcttgtccgaatccataaaacgcctcctctcgcctttttaagatatgcgatttttggaaaaaacacaagggatattttgacgaaacgcgccgcgcaggggagcccttgacaaaaaggagcggtttctgtataatcgaatagtccgaaatcggacaaaataagacgggagggattcgatgggacaggaagttctggatgctttctggaaatccaatgaccgaatctacaatgagaataccctgctgtaccaccgtctggcccgggcctgcggcctgccggactgcgccttctggctgctgtacaccctgcggtcggaggaggcgcccctgacccagacccagttgagcgagcagctgtccctacccaagcagacggtgaattccgccctgaaaaagctggtggaggagggagtcctccgcttggaggcggcggacggcaatctgaaaaacaagcgggtctgtctgacagaggcgggcgaggcattcctccgccgcactgtggaccgcgtgttcggcgtagagagcgccgcggccgcccgcctgaccgaggaggagcggtcggcgcttgtggcattgagccagaagctgctggatgcctttcgggcggagacggaagcttttttacagaccgctgcgataggagactgatgtatgcagatcaaactttctgaccatttcacctacggacggctgctgcgttacacactgccgaccatcgttatgattatcttcacctctctgtacagcgtggtagacggactgttcgtatccaacttggtgggggacctggccctgtcggcggtgaatatcgccttccccatcactatgatcatcggcgccttcggcttcatgctgggcaccggcggcagcgccatcgtggcccgcacgctgggggaggggaagccggagctggcctcccgatatttcacgctcttcatctggtgcgtggcggggctgggcgtggtgctctccattgtgaccatcgccttcatcgaacccatcatgcgttttgccggggctagcgacctgctgctggaagactgcatcgcctacggccggatcctgctggccggcagtgccgtgttcatgctccagagcgcctttcagagtttcttttccgtggcggagaaacccaagctggggttactgctctccctggctgccggagccaccaacatcacctttgactacgtgttcatcgccctgctgggcatgggtgtcaccggtgccgcatgggccacagtgctgggctactgcgtgggcggtgtcatcccggtggtgtacttcctgcttcccagaagagagggcctgcggctggtgcggacgaacttttacggccgggaactgcttcacgcctgtatcaacggctcctcggagctgatgagcaacatctccgcctccgtggtgggcatcctctacaacatccggctgatggaccttctgggagagccgggcgtggcggcccactcggtgatgatgtacgtggatttcgtgtttgtggctgcctttctggggttctccatgggcagcgcccccatcgtcagctatcactacggggcggagaactatgatgagctgaagaacatcttccgccgcagtggcgtcatcatcgccgctacctccgtggcgatggtggcggcgtcggagctcttaagccggcccctgtctgctgccttcgtggggtactctccggacttgctggagctgaccacccacggcttccggatctttgccctgtgctaccttttctgcgggctgaatatctacgcatccgccttcttcacggccctgtgcaacggcgccctgtcggccctgatcgccttcacccgcacgctgctgctgcggggtggactggtgctggtgatgccggtgttcttcggcgtggatggcgtctggtggtccgtggcggcggcggaactgctgggggtggtgctctcggtggtgctgctggtgctgatgcggcggcgttaccattacgcctgacgggggaaaacgcggatatgttacaagacggcggctccgctcaggtggtatgctggctggtgccgacaggagggaagaaccatgagacaagcggcgcggaccgcccgatatgaccaggctctggggctggaggcgtacagcctccgggcggtggacaggccctttcccagccactttcacgaccattatgtgatcggcgtggtggagcgggggacccggaccctcacctgcggccgccaacggcaggtcatcggcccgggagacgtgctgctgttcaacccgggagacagccatgcctgcatccaggcggacgggtctctggactaccggggactgaatatcccacgcagcaccatgctggccctggcggaggagatcatgggcagccgggcaatgcccggcttttccgtggccgtggttcgggacggagaactggcaggccgcctccgggccctgcaccgggcggtgctgggggaggagccggagctccggagggaggaggcgctgctgctggcctggggcctcctgctgccgggttacgccgggatggtggaaacggtttctgcctgccgggtggaggtggagcggacctgtgcgttcatccggagccactatgcccggcatatcacgctggaggagctcagccttcaggcgggactgagcaaatccgccctggtccgggcctttgccaaggccaagggcgtcacgccctaccgctatctgatggcggtgcggatcagcgaggcacggcgcctgctggaacggggtgtctcctctgcagaggccgccgtggagacaggcttttccgatcagagccatttcaccaactatttcactgccttcaccggcctgacgccgggggcctgccgggagctgttccggcaggaatgggagagaggatgacacagccgtggagacgaatcctgcacggggccacctggcggccctgctgaccattgtgatctggggaccaccttcatctccaccaaggtgctgctggtggatttccagccggtggagatcttgtttatccggttcatgatgggctttctggcgctgctggcagtctgtcctcgccgcctgcagggcgtcacacggcggcaggagggattgtttgccctggcggggctgtgcggcgtgtgcctgtactacctgctggagaacatcgccctgacgtacaccatggcctccaacgtgggggtcatcatctccgtgtctccctgcttcaccgccctgctgacccattttctgatgcggggcgaggagcggctgcggcccacatttttcgcaggctttgcggtggccatggcggggatctgccttatcagcttcaacggctctgccctggagctggacctccggggggatttgctggcgctgctggctgccttcgtgtgggcctgttacgccctcttgtcccggaagatcagcgccctgggccatcccactgtcctgaccacgcggcgaacctttttctacgggctggcattcatgctgccggcgctgatggtctctggcgtccggctggagctcacgcgactcacagccccggtgaacctggggaatctgctgtttctggggctgggggcctcggccctgtgcttcgtcacctggaacttcgcggtgaaggcactgggggcggtgaaaaccagcgtgtacatctatctggtgccggtgatcacagtggcggcctccgtgctgatcctgcgggaacccttcacctggatgaccggagccggtacggtactgaccctgatcgggctgcttctctctgaaggcaaactccattggaaagagggaacacaccatgaaacaggaactggacaaatgcgtcctggtgattgatgaggccatgccccggggcctcgctgccaacacagcggccatcctgggcatcacatggggccggctgcggccggaactggtaggggaggacgtgaccgacgctgccggagccatccaccccgggatcatccgcacgccggtgccggtgctctccggcaggccggagacttttcagaccctgcggcggcagctggccgagctggaatttgcagatgtggcggctgtggactttacagatctggcccagagctgccgtacctacggcgagttcatcgaaaaaatggcccgcaccgggccgggggagctgcgatacctgggcatggcccttttgggcccccggcatcaggtggaccggctgaccggaagcctgccgctgctgcggtagggaaaaaacgcaggaatggggccgcgcccggttgcggccccattctcgtatcatttcccggaggacttatggcccctgctggatcaacagatccacctcagcatcaccgccattggtgtacaaatagctgcaggcaaagccgttcacttcccagatggcatacgacatactatcgtattggtagtatgcgacgctgacgcccgcaatctctctgctctcctccagtgtgccgccgtagattccgctgatgtctccactcccatactggatacgaaactgggagccgtccgcatagtccacctgtcccatggtggggtacccatctgagatgaacacggagtacgcctccacctctttctccagcacagggaccttgaagtccagatatgcttccatctctgcggcggacgcgactgtgaggatgggattcgggatttgaacctgctgaggatccggggcagcgcgccctctgccctgaatcagcagtgccccgccggtggccagcaggcacaggcaggccgccgcggcgccccaccggacccaaaaggactgcccgtgctttcgcctgtaccgggcggcctcttccacatacctgccgtcgagcgcactcagagcatcggaaaacttctttgcattcataaaaacgcctctctttctgccagatattgtttcagcttccttcggatccgggccagccggacggagatatttttttcgctcagcccgacaagcccggcgatgtcccggcagctgtcagaaaaccagtagcgccgcatgaagattacgcggttctctgcggacagcgtatccaaaaagcacgcaatgacgcgggcgagctcccttgcctccacctcttcctcggcgctctttcggtctggaagacactcctcgacttcctgcaaagcaagggtgtaaggactgtttcgcttggcagcgccctttttccaatagcacttcagggaaatgttgcggacgatccgcgccatatagggcagcagagagtccggttttgccgggggaatggcattccatgcccccaggtacgcatcattgacgcactcatctgcgtcctgcctgtcattcacgatgtgataggagagactgtggaatagttttccatatttcgcgtccaatgcctcgatagcctgttcggaacgtgcaaagaacagtgtgatgatctgttcctcatccatggttgctccacctcctttccggtttcactttgtacactacgtttttttcggcaaatcctacaacagattccagtattttttcaatatacgatcatgcggccatacggccggaagagaagcggagaaggccgcagttccagctgcgtctgcggaaaagacaacattgcatcccaggtgacaaaccgggggaagtgtggtaagatattccggtatgaaaatttctgttccccaaggagtcctttatggaaaactattttgaaccgaatctcaccgacgaccagctgcgcgctatcagttccatcggcctggcccacatgggggacgccgtgttcgaggtgctggtgcgcacctggctctgtgcccatggcaaggccacgggaagggggctgcaccaggccaccattgccctggtgcgggcggagagccaggcggagaaggcggagcggatcctgccccttttgacggaagaggaagccgctgtgttccgccgcgggcggaacgctcacgtgaagtcggtgcctggccatgccacccgggcccagtacggcgaggccacggccctggaggccctgttgggctggctgtatctgaagggccggcgggaccggatcaatgcgcttttccgcgcgatgatggaggagtaagaccatgccattggatggaatctgtatgcaggcggtggcggaggagctgcggtcggaactgctgggcctgcggatcgataaggttcagcagcccgcccgggaccaggtgatcctgctgctgcgggggaataagcggctgctgctgaacgccggggccaacactccccgcatccagctgacggccctgacaagggacaacccggcggagccccccatgttctgtatgctgctgcgcaagcatctggttgggggacgggtggctgcggtcacccagccgcccctggagcggctggtacggctggagctggacgttactgacgacttcggtcagccggggcggcggaccctggtgctggaggccatgggccgccggtccaacctgatcctgctggatggggagggccggatcatcgactgcctccgtcgggtggacgcggacatgtctgctgcccggcaggtgctgccggggctgtattatgagccgcctgcctccgtaggccgcctgccggtgacggaggagacggagaacggcttccgggagaagatctccgccgcaaacccggagcggagtgtggacgcctttctgctggaccactacttcggcatctccccctgatcgcccgggaactggccttccgctccgtaggggagacggatgcccatctctttgacctgggagcggtgggagaggaccgcctctggaaggaattgtccgggctcatcagagatatacaggaaaatcactttacaccaatctgcctgaaaaaagatgggaagatggcagatttcacctactgccccatcgcccagtacggccctgttatggagaccgtccggtatgacactttttccaccctgatggatgacttctacgccctgcgggagcagcaggagcgggtgcgtcagcggggggcggacctgctgcggactgccaccacggcacgggaccgcatccggcggaaactggccatgcaggagaaggactacgccgccacacagaaccgggaccagctgcggatctacggtgacctgatcaccgccaacctctaccgcatggagcggggggcggccagattggagacagagaatttctatgacccggagtgccgccctgtcgccattcccctggacccgctgctgacgccccagcaaaacgccgccaaatactacaagcgctacaccaaggccaagacggcggagaagtatctggcggagcagatggcccttgcccgccgggacctggactatctggagagtgtgctggaggagttgagccgggcagagacggaacaggactttttggacatccgcggcgagctgcgggacgcgggcttcctccgccgacagggaaaaaaggaacagaaccggcctgcaaagcctctggagttccgcaccacctccggcttccgggtgctggtggggcggaacaaccgccagaacgacaagctgacccgcagcgcggaccaccgggacatctggctccatacccagaagatccacggttcccacgtgatcctctgcacaggcggccgtgaggtggacgatgacaccatcgtggaggcggccaagctggcggcctggttctcccaggcccgggagggtgccaacgtccccgtggactacacaccggtgaagaacgtgaagaagcccgccggtgcccggcccggcatggtgatctactccacctgccgcaccgtgaacgtggcgccggaggaggggcttgtgaagaaacttcaattgtcataaaaaagttgttaaaaagaagctgcttgttggtcaagcagcttctttttctttcaaaatatccaaaaacaggaatcttttttgtgcagaatggctcttgcaaaacgggagcaaaggtttacaataaagctctcctgaaaacgggaggcaatcagtattcagacctcagaaagcgagtgagaggcaatgacgtatcattatctcatggacctggcgctgatcctgttgagcaccaaggtgctgggcatcctgacgaaacgcatccagatgccacaggtggtgggcgcactggtggccggactgattctgggcccggctatgctgaacgtactatcagaaacggagttcctcacccagctcagcgagttgggcgtgatcgtactgatgttctccgccggcatgggcaccgatatccaggagctgaagcacagtggcaaggcaggcttcctggtggccctgctgggcgtgatcgttccactggtcctgggtacggggctggcgatgttcgctgaccggaccggcatgattgagaccagcggatttttggaggatgtgttcatcggcaccatccttactgcaacttccgtcagcatcacagtggagacactgaaggagatcggcaagctggataccaaggtgggcaacaccattctggcggcggctctgatcgacgacgtgctgggcctgattgccctgaccatcgtcagcagcctgtccggcggacaggacagcatcgccctggtgctgctgaagatcgtgctgttcttcgtgttctccgctgtggtctccttcctcgcccacaagttcttctgctggctgatggccctgtggcccggccgggagcggcgccgctatccggtgctggcctttgtgctgtgccttctgatggcttactgcgcggaggagttcttcggcgtggcggacatcaccggcgcctatgtggcgggcctggtgatctcctgcacccccaagtcctcctatatccaatccaagttcgagccgttgagcttcctgctgctgacgccggtgttcttcgccagcgtgggcatcaaggcaaaggtggacggcatgaccggcagcctggtgctgttctccattctcctgctgctgatttctgtggccaccaagatcgtcggctgcggcctgggcgcaaagctctgtcatttcactggcaaggagagcctgcaggtgggcgtgggcatggtctgccgcggcgaggtggcgctgatcgtagccaaccggggtctggagctgggagtgctgtccgggaccctgatggcaccggtcatcatcaccgtggtgggcggcacgatcctcacacccatcctgctgaagctggtattccggcacgacggacagccggccagcgcggcggacagcaatctggcagaccactatgagaagatggagcagctggatatcgtctccgcagagcttctggccagggaccagaaatacctgaaagaaggggagcacggcggagacaaggaccgcggctgatctgctccggtgactgagaaccgcaaatacggggagccggccttttggtcggctccccgtattttgaaaagcgcgctgtatccgccgtcaggcggtgtggcgggcgtggcccgtctcctcgtcggaggagcggaacaacagcgtgatgcaccacaggcccgccaggcccaccagggcgtagatgatgcgggagagaatggccatctggccgccgcagaggaaagccaccgtatcaaagccgaacaggccgatcccgccccagttcagggcgccgatgatagccagtgccaatgcgatcttatcaatcaccatgcgaaaaacctcctttatgccttccagcagggatttggcgttagtgtatccaacggggcgggaactatgcggatggggaaaatttccagcctggacaaaatttgcaaatcgcattgcaaaggaaagatagggattgtataatcgaaacagcgggatccgatctcgcccgcggcgaagccgcgcagaccgattgataaggggagacagtatgaatattgtatgcttggatatggagggcgtcctggtgccggagatctggatcgcattttcagaggccagcggcattccggagctgcggcgcaccacccgggatgagccggattacgacaagctgatgacctggcggctgggcatcttgaaggagcacggcctggggctcaaggagatccaggacaccatcgccaagattgatccgctgcccggcgccaaggcgtttttggacgagctgcgggccaccacccaggtgattattctgagcgatacctttgaggaattcgccaagcctctgatggaaaagctgggctggcccaccatcttctgcaactccctggaggtggcggagaacggcgagatcaccggctacaagatgcgctgtgagaagtccaagctcaccacggtgaaggccctgcagtccatcggctatgacaccatcgccagcggcgacagcttcaacgatttggggatgatccaggccagcaaggcaggcttcctcttcaagagcacggagcagatcaaagccgaccacccggagattccggcctttgaggagtttgacgacctgctggcggccatcaaggcggcgctgtaagagttttccggaaagaaaggggacgcgacatgaacgagaaattccagaagctgggcttttacccggcggatatcctgctgcccaaggatgcggacatgaccaagtgggccgtggtggcctgcgaccagttcacctcccagccggagtattggcaggcggtggaggagactgtgggggacgcgccttccaccctccggctgatcctgccggaggccaagctgaacgacccggatgtggacgcccatatcgcggacatcaacggcgctatgaaccgctatctggcggagggcgtctttcagaccctgccggggtccctgttctatattgagcgcacgcagtccgacggcaaggtgcgccacggcctcatcggcatggtggatttggaccagtatgacttcacccccggctccggcgccctgatccgggccacggaggggacggtgctctcccgcatcccaccccgggtacgggtacggcaggacgcccccgttgagctgccccacgtgatgctgctgatcgacgacccggaccgcacggttattgagcccctgaccgccgccagcggggagatggagcagctgtatgactttgacctgcagcagggcggcgggcacctgaagggctggaagctgacggacgcccagatggacgccgtggcggacgccctggcggctatgtgcacgccggaggccatggagaaaaagtacggcctgaaggacgcggcacctctgctgttcgcggtgggcgacggcaaccactctctggcaacagccaagcagtgctatgagaacctgaagaaggtcacgccggaggaccagtgggccgatttgcccgcccgctatgctctggtggaagtggtgaataatcacgacgacgccctccagttcgagccgatccaccgtgtcctcttcggcgtggagcccgaacaggtgctggaggcgatgaaggccgcctatcccggcgcccacgaaggggagggcgagggccacaccatcgcctacacctatgcagggcataccggtaccatcacggtgcccaatcccaggatgcagctggcggtgggcacgctccagaccttcctggacgcctatctcaaggagcacggcggcgaagtggactacatccatggcgacgaagtgacggacgagttgggcagcaagtctggcaacatcggcttcaagctcccggctatgggcaaggaacagctgttcaagaccgtcatggccgacggcgtcctgccccgcaagaccttctccatgggccacgcccaggataagcggtactatgtggaggcccggaagatcaagtaagaagtcatttccacagatacagacagcgccgcaggcttttgcctgcggcgctgtttcttctgaaacctggcaaaagccgcgggaccgccgcggcttttggggagagcgtctttttaaaacaggcccctccgcctccggaacttctgggtagcttcatacgcgaaacagagcagggcgagggacaggattgtgatggccggcaggagcagggctgcgtacagcaatgagcttctgctcaaaaacaggatgtccagcatacgatgctcttttctggtgctgttgggggggattgcccaaacaattcattccaccccctctgtgctgcgtataaatgcaccgcattctgttaaaaaagaaagaagatttgtgaaattttacatgacgccgggcattcgttcaaaaggcagaatcccggtcgatcacgttccagtgagaggcggagactgtctgcccatccttgcactccagctgcacttccaaatgagaataaaggctggtggggagctcccagcggaacagggcgaaggtccggccgttccggatccgccggacgccgatctgctgccgctcctcggccactccggtgccggtgggatacagaaacaaaactacctgatccaccgtgtgctcccggccgtcctgaaaggtgaccgccacgttcacggtgctgtctggcggaaacagataccagccgaagtcgcttttggcgatctcctgcccggccgcatcatagaaatagacgcctgtaatctgcggatcctccggcggcggccagccgtcctgatgcgcgctgtaaaggatccagcccagcgccgccagcagcgccaggcagaggagccctgccgccagcgtcagccgcttccaccgccgcagagggacgggcggcgctgtttctctttccacttgaaggtctgtccccaaaatctccgagagcgcccgccgattttccggagagggaacagaggttcccatctcccacttggataccgcctgccggctcacgcccagccgctccgccagagcctcctggctcatgcccaagcgatcccggccttcccgaatcgccttgctcatgtccatgacgcaccgcctcccgctccgctgctctcagcatagcaggtttttccggttgcgtccaccaactttccgcaaccgtccggttgcgggcgattcattgtttctacttggggagggatgtgctatactggacccagacagcgggcggaggcccgcgggaggtggtgcgatgaagactttgacgctggaggccccggccaagatcaacctgactctggatattctggggcggcgtacagacggctatcacgacatgcggatggtgatgcaggccgtgtccctgggggacaccgtgacggtggcagaggcggcgggcggcttttccttgctgacagagggcatctcccttccggcggggaaggtcactttggagcagcgggcggcggatgcctttttccacaggctgggccgcccggtgccggggctggaggtacgccttgccaagcgggtcccggcttatgcggggcttgggggcggcagtgcggatgtggcggcggtgctgcggtgcctgcggaccctgtacgccccggatctgccgcggcaggcgctggaggagatcgggctggcagtgggcagcgatgtgcccttctgcgtccggggcggcacatgtcttgcagagggacggggtgagctcctgacggacctgccgcctctgccggactgtgccatcgtactgtgcaagccggacttcggcctgcccacaccggagctgtttgcccggctggacggggcggacctgggcccccggccggatacggcggccatggcagcggcgttggcccggggcgatctggccgccgcggccgcctgccttggaaatgtttttgagcgggtgctgacggaggaggaaggggaggagatccgctccatcaaggaagccctgctgcggcacagtgctctgggcgcggccatgagcggttccggccccacggtgttcggcctgtttgatgaccggcagaaggcggtccgggcaaaggaggcgctggagggacgttaccggcagacgtatctggccgcgccggtaaaaatattggaaaagatggaataaaatccggaatttccgtccatgatgggggaaacgggccccatggggctacatagcaaaggacggaaaacggatatgaaaacagctgcaaagcgtgagcgaaagactctgcggatcgtggaactggccctgctgctgggtgcggcggcgtttctgatgaccggcgtctgggcgctgaacacccagcgggacctggcggacaaggtggtgcggctccatgtgctggccaactctgatacggaggaggaccaggcactgaagctcctggtccgggatgcggtgctggagcgagccacggagattctggagcagtcggcggaccgggcggaggcagagattcgcctgcgggagagcctgccggaactggaggccatcgccgaggagacggtacgggccaacggctatgactacgccgtgacggcggagctggaggacacggcctttcccaccaaggaatatgacggcttctctcttccagccggggagtatctggccctgcggattctgattggggagggcgtcggacagaactggtggtgtgtggtgtttccgcccctgtgcaccgctgcctccgcggacgtgccggagacggccctggccgctggcctgacggaagaccaggtcagcctgatgacggaggaggatggcggctaccagctgaaattcaaggccgtggagctgtgggagcgcctgaaggcggcgctggagtgagcgggagccgcccttgacacggcccgctgggaacggtatcataagggccgggaccggactttcctgcggccccacggcggggagcggcggatggccggatgctccgcactttccagcggggaggagacggcggcatgagagaggcggaactgaatcggcagcgggtggtgttcacaccgcaggaggcggcgcgcctgcctcaggaccggccctatgcggcgtacatctgccactatgactgggcggagggagagcacgccacactgatgcactgccacgagcgcctggcggaggtgctgctgatcctgaagggcagcggccggtacaccgtcgatctccgccggtacgaggtggcagccggagatgtggtgctgtgcagcggcggcgccctccacgacgaattcccccaggcagaccagccgtatcagaccctgtgcgtggccatcgggaacttggcgctggcggacctgccgccatacagcctgctttccccggaccgctgccccctgtttcaccagccggagcagtttgcggacctgaaggagctcttctgcctgatggaccggtatgcagcggagcgggagccgggcttccaggagctgtgccagcacctgatgctggcgtcgctggagctggtccggcggatggcggcggggcggaaggaggatctcgtcacccgggaggactccaccttcggccgtgtggccagatacatcgaccgccattatgcggaggacctctccatcgagcagctggcccgccagttttatctgagtccctatcatctgtcccatatcttccggcagaagacgggatacagcctcaagcagtatgtcctgcgccgccggatcggggaggctcagatgcggctggtgaacgcgcaggacagcgtccagaccatctccgaggcggtgggattcgcggacgccagctacttctcacgcatcttttcaaaatacgtcggcctcacgcccacggagtaccggaaattccggatcgggccgtgagaccgcagaaaagtccggaaaaaagacctgcggagggaaccgtgccgttccccccgcaggtttgtctatttcattccgtcaggtatatttgtatactttgtccagcatcctaagcagaagacggatgaatagggaggagatccagatgaaacggacatggaggaagaagatcggcgcagttgtggccctgctggccgccgtggcagtgctgggtaccggctgcggcgcggacgccgccggggctgtggagtcccggaccagggagacgagggctctgggcctgctgctgtctagggaggatacgtttttgttggagctgaaggcggacatcgaagcggaggccgccgcccagggctacgcggtgcggtattacaacgcgggcaacgacccggagacccagctgcgccaggtccacgaggccctggcagaaggcgtggagaccctgctggtgaaccttgcagacggggaggactccgaaaaggtggcagacatcgtgggcgacgcaggggtcgtgctgctgaaccgggcgccggggacggcgatcctgaacgagcggatggtgtttgtgggcatggacgaggccgggagcggcgccctccaggggcacgccctggcggagtatttctgggagacggaccacgggacggatatccgctatctgctgttccaggggatgcccggccaggagaatacagatgcccgctccggcaccgccgtgcagagcctgctggacgacggcttctgccccatcgccgcggcagattaccaggtctgcggcttcagccgggagcgggcccgccaagccatggcggccctgctggagcagggcgtggactttgactgcgtcatctgcgacaacgatgaaatggccctgggagtcatcgaggcgctggaggccgccggctgggatccgggcgcggcgcccatcgtcagcgtggaccacacggcggagggggccgccgccctggagagcggcaagctctatatgacggtggaccagaatccggaggaccaggcccgggcggcggtggcggcagccgtcaatctggcccggggtcgggcctatgacgacgggctccgggagctgctggggaacgactgcacggacccggagcagccctttgtactccgggttcctgtggaggcggtgaccgcttgacgtactgccttgctttgccggagtgcagaaaagcctgtgttcagaaggaacacaggctttttcagcccagaaggtactgcgggacgggcgccccggcatgggatcagacagggaacggatgcggaacgcgggctgcacagcatggattccgcacttgaacgggcatatcccgaatcggcatgcgcgatgaaaggcgggtgcgcaaaaccagctgcaaactcccactctgctccgcgtgcggataccatccgaaaaaatttcagattttttcacgcttgctcttgactttgagtgtactccaggtgctatcctataaacgtgtcggatgaccgatgcgcaataccacggctgccggggggctgaagagatgcatgaggaatttcaaacggtcctgcgggagcacctggcccgctatccgctgatggagccccaggactgcgccaagctggcctatcagagtacgttcggtccagcccatgcagcgggggaacggggagatgtcctccggcagctgctgggggagtgcagcgcccttcccgcagaccgggaggcccggccgccggagcggatcgggaacggtttgtgccgcgttcatttggcggggacgggggattggacgctggctgcgccgctcctggcggatctgctgcttctgacggcggcggagcaccacgggacggcggcggacctggaggaatgcctgaccgcggcggaggcgctgcccctgcccggtatggcggactggctggcggtgtaccgccgtcagggctgtccgcccgtccaccactcgccggcctaccgggaggcgtatgacccccactaccgggtcctgcggacagcatacggcgggtacttcccggcactgctggcggcggcccggctggcgcggagcggcagaccagccgtcgtggccattgacggccgctgcggcagcggcaagagcggcctgggagacctgatggggcggctccttccctgcaacgtggtccacatggacgactattatctcccaccggaccgccgggcagagaactgggagcagatcccggctggaaatatggacctggcccgcttcctgcaggaggtactggtgccggcaggggccggagcgcagatccgctgccgcccgtatgactgccggagcggcacgctgagggaggggacaacgcttccggcccggcccctcactgtggtggagggaagctactcccagcacccgctgctgtcggcccgctatgatctgcggatgtttctcacctgtgcgccggaggagcagcgccgccgcctggagcggcgggagggcgcccacttcgccgcctatgagagccggtggatgcccctggaggagcggtatatccgccaatgcggcccggagaagggctgccagctggtgatcgacaccaccgaatttttcccctgacgaggggcaagtccctgaaaaacgcccggccagaaggccggtattcacagccctgcagactccgtaaaaaaagccagaaggctggtgcggcgccagaaggcggcgcgaaaagactttttgagaaggagtttaaccccatgaaacacagcaatttcaaaacaaatgtccataacctggtcctggcggccatgttcctggccctggcgctggtactgcccttcctcaccggacagatcccccagatcggcgggatgctgctgcccatgcacctgcccgtgttcctctgcggcctgatctgcggctggcggtatggcgcggtggtgggattcgtggccccgctgatgcggatggcgctcttcggaatgccgccgctggtggccgctgtggccatggcctttgagctggcggcttacggtggcatcgcgggctttttgtacaatcggtcccgctggcagtgtgtggtggccctgtaccgtgctctgctggctgctatggtgggcggccggatcgtctgggctgcggtgcgggtggtgatgaccggcgtggccagcgtgcctttcacctggcagatcttcctgaccgaggcgctggtgaacgccattcccggcatcatcctccagctggtgttcattcccgtcctgatggtggctctggaccgcaccggcatggtccgcttccgccgggagcaggccggtacccaggccgccggaaactgactgatcggcggcttctttcgcaggcagagcaggcccccggcggaccggacacgttccggtccgccgggggctttcacatgccttgccgcccgccggctcaccggagccctccaagctggggagccggctctgcgctgccgggaatgtctggcgcggcgcccggatcgttccagcatattttgccggatgcactgcggcccaatagatgcggctgatgtgccaggcatttccagtcatctggaaaatccggaaagcccttgcgtggctctgccccgctgtgttaggatgtgaaccgtgcttttgaggccggattttccgctgcctgcttggctttttgacagaatccgcaatgatttggcagaatttctacatctgggaaggccccttttcggaccggacggagagtgcccgcttcaaagcgccgatacctacaaaccaatcgggaggaatctacacacatgaagcgagaacttgttaccggactgctgactctgagcctgctggcctccatgctgccggccaatgcccaggcggcggaggggatgtttggtgcgtctgccgccgggcaggtccagaccatgacggagggggccggggaggacggcgtccaaacggaaaacaccgcggatatcgacggcacccagtatgccaccctggcggaggcggtggcccaggcggaagagggcgccaccatccggctgctccgagacgtggagctggacgcctccggcctggtcaacggccagggagcgctgacgctgtccaaggacttgactctggacggcagcggccataccatccgggcgaaggcgggcacattttctgtctccggcgacaatggcaccggccccagcctcctcaatcttcaggatggcgccgaggtgacgctgcgggatgtgacccttgacggcggcagtgccgccaagcacggcctgaacatctaccacgccggaatggtgaccctggagaacgtggagatctccaactgccgctggtacgccctggtggtcaatggcacggagctgtccgtggacggcctgaccacctccggaaaccagtggggcgtcaacatcgaccggggcagccgcgtcacctttgcgaacgctgctattgccgagggggattccattgtctttgaggggcaggatgcctccggcagcctgaccgtggagagcggcagctatcagaatatcaagacgcagggcggctccactggcggaaccatcgtcatcaacggcggcaccgtgggcagcgtagtcaacgacaccgcggcggagatcaccatctccggcggcactgtgaccggtcaggtggccaacagcggctccggcagcatttctgtcaccggcggcagctttgccactgcagagctggaggatttcattgacccggaccggacgatcatcctgaccctggagctcggcgagggcgccgccggcgcggccgccatggcagccaccagcggcgcagccgtggggacgcttcccacgccggagcggagcggctacgccttcgcgggctggtacaccgccgccgacggcggcactgcagttactgccgataccgtcttcgacgcaaacacaaccctgtacgcccggtggactgagaagtccgaggacggcgagcatctcattactgtggaccaggtcaccggcggctccctggaggtgagtgccggtcgggccgacgagggtgagacggtgaccatcaccgcggcgccggatgacggatacgagctgaagaagctgactgtcaccgacagccaggacggcgcagtcccggtccagaacgcgggggaggggcgctataccttcgtcatgcccggcggcggggtgaccgtgtccgcgtccttcgtccgttccggggagcagacggaactgcccttcacggatgtggacagcggcgcgtactattacgatgcggtccggtgggctgtggagcaggggatcgcctccggtgtcaccggaacggccttcgccccgggccgcggatgcacacgggcccagcttgtgaccttcctgtggcgggcaaacggctctcctgagccgtccgaaaaggagaatcccttcacggatgtgagccccgacagctactactataaggcagttctgtgggctgtggagcagggcatcacctccggcgtcaccaagactgcctttgccccggaccgggtctgcacccgcgctcaggcggcggtgctgctgtggcgggccgagggctctcccgcagcatccgggacgcatgacttccgggacgtggcggaaggtgcgtactatgcggacgcggtggcctgggccgtggagagcggtgtgacccagggcaccacttccactacctttgagcccggcacgacctgcacccgggcgcagatcatgaccttcctccaccgcgccatggcgtgacagagagggccccaggacagatgcaggcaggtccggctgaatcgcccggccaggacgcagcccatgtcaaacggcgggccgcgcggagattctccgtgcggcccgccgctctgcctttcaaggaacttaaaaaaataaggagaatccgcagcatctctggaatttttccgtctgttgggatagaatggaatcaccattccggaaactgccgacaatggagggacgaatgatgaagaagctgttttctttgacgctggctatggtgacggctctggggctgatgctgccggcgtccgccgcagaggagaccacagacgaggccctggccagggtgacccaggccgtaaaggcggccctggatctggacacggatgcctatgacgaatttcagggcagctggtatgaggatggtctgaccggtgcctgggatctgtactggtcgaccgagttggaggaggaactgtccatttccgctctggatgacgggaccgtaatcagctacgatctgggtctgccgtacaccgcctccaacagcggggatttcccggtctttccccagggggatgaggccgcggccgcccgggccgccggggactttttggacaaggtcctgcgggagggggagagcgtgaagctggaagagccccgcggcatggatattctgggcggggacagctaccgctactccggagtgatcctgctgaacggcctgccctcgccgctgacctattccatcactgtggatgcggcggacaaccgggtccggtctttccaccggaccacagcggaggacaccttcctgggagacgtcccctctgccgccgctgcggtgcgccgcgaccgggctgccaaactcctgacggataccctggagctgaagctggaatacgtgcgggaggcgggcggcacgtcggccgtgctccggtatctgccggtggatacggacaccttttatgtagatgccgccacaggagcgcttttgaatctgacggagctggaggaccagatgggcggctggggcgccggaggcagtgccgacaacaccgcggctgcggagagcgaggacagcggcctcagcccggcggagcaggcgggcatcgcccagatggagggcgtccggtcctccgcgttcctggaccagagcctgcgggcagagccggtctacggcctgacggagtacgccctgtcctccgccgcctaccgtctggcggaacaggaggggaaggaggatcaggtcctctgcgtcctgtcctatgtgcggcccggagaggaggacagccgttcccgcaccatcacagtggatgcccgcaccggcgcggtccaggaggtattctcctacgcacccggaatggaggagggggagacaccggccctgacccaggcggaggcgcaggtcaaagcggagacgttcctgtccgccctctgcggcgggcggtggagtgccctgacactctatgacggccgagacaacacggaggaccggcgtccgtactacaccttcacatacgtccagcaggtaggcggcattcccttcccggagaaccgctataccgtggccatcgacagcggagacgggtccgtgtaccggctggattatcagtacgacgaggatgtgacgttcgccggctccgccggtatcgtgggtgagacggcggccctggccgcctgggcggggacctatgacacggtcctggcctaccgtctggtgccccgccctctggagagcggcgacgagacggaagcccggctgatggagctggggcttacccacttctacgagctgcggctgacctacgctctggagcgggaggagcggtatctgggcattgacgccgccaccggcaaaccggcggcgccggagtccggggataccgccatcacctatacggacctgtcgggctccggggtgaaagccgatgtggagaagctggcccgctatggcgtgggctatgacgggggccgcttccggccggacaaacagctgacccagtgggatctggtggccctgttggccagcctggagggatactgtatcgacccggagacagcggatgagagcacgcgggacaccgtctattccgtggcctaccggatgggtattctgccccggggaacccgggatgaaggcagggccgtcacccgcgggcaggcagtgaaatgtctgctggactgcgcaggttatggtccagccgcccggcttcagggcatctacacctgcacatacagcgacgctgccgccatcccggaggcagacctgggctatgcggccatcgcccaggcgctgggcatggtccggggaagctatcagggggaccggacagccacccggggagagctggccgccatgctctgccgcctgctggagcggcagggagcaaacgcgggcgcctgaacgggcccgccggatgatggaatttgggaggaattacacatgaaaaacgtattcggctatccggagtttgacgcggagggcgaggaaatcctctgtacctacgacaacgcatacagcgatatgctgatggacatccgggtctaccggatggaacccggccggaagagaggcttttgccgacggggcgaggagaccgcggtgctgcttctgtccggaaccgtgaccttcggctgggagggccggacggagacggtcagccgcagagacgtgttcactgacggcccctatgccctccatgcctgcgccggggaggagatcaccgtggaggcgcagacagacgcggagatcctggtccagtgcacgaagaatgacacagcgttctccggcaggctgtaccggccggaggacgccccctgggtctactcctgcgtgggcaagttcggcaatgtggccaagcgccgggtaaacaccatctttgacaaggatatcgccccctggtccaatatggtgctgggcgaggtgctgaacgaccgggggaactggtccggctatctgccccaccggcacccccagccggagtgctattacttcaagttcgaccggccggagggcttcggcgccagttttgtgggggaccaggtattcaagagcgtggacaacagcttctccgccatccccggcgggtgcctgcatccccaggcagtggcgccgggcttccagatgtatacctgctggatgatccgccatctggacggcaacccctggctgcagaccacccgcaacgaggacgagcgatatctctggcttcacgatgcgcaggagtgacctgcccacagagagttgaacagcggaaaaaggctccgggtttctctgggaacccggagcctttttatttggaaacaggtccggcacagtggtccggttccagaagaggcgccgtcccgggacctgcctgggacagccggagcccggcgccacgcacatggtcccgcagcacttggtctacaaagcggatcagctcctccggcgtgccctggatctcgcccaggagccagtcctccacaatacttaccagcgcgcccacatagaactgagtcagcatggtgagctcctgctccccggcctcataccccagctccgcggcaatcagacggatcgtgctccggatgatggcgcggatatccgtctggaagaaccgcttcaggtggtcccggcccatggagcgaagggcgcagaggcagaacacacggttctcctgcaggtattggaaaagctggagcaggccgtcctgccacagcatgacgccctcgtgttcccggagcagcgccaccgcctcctcctcaaagatccagcgcaccgcgtcgtagacatcgtcaaaatggtagtaaaaatgctggcgcgccatgccgcagccccgcatgatctccgccacggtgatcctgttcaggggtttctgggtcatcagctccttgagtacagtgcagatctgccgcttggccgcattgctggcctcgtatgtccgttttttcatatcgacctccatggaccggcagactccagtccattgcagtccagtataacacattttccagaggagtgcatctatgcagaatgggggcaagtgtcagatttctgacatctgcccaaggtctgcaccttgcatctccgggcctgtttccagtatgctggaggaaatgcggaaaggagcggaggaagatgcgggaagagtatcacgtcacgctgtacagccagatgggccccagggagggtcgcctggacctccaatacgagggttctgccgtcacaggatccctggaactgatgggacgccgcaaccccgtccatggcgtacggtcggaggatgggcatctgtgcctctctcatgctatccggacggcggtcagcacccttttctgcgagacggcgctggagctccatggggaacgccttactggagtgaccacggcggacgtctgccggatgcgatgggaggggagccggatctcccctgagccgtgatgggaccgggattgccggaaggagctgaaactgtgcgcaaagacactgaaaaaccatccttttttgtgcggctggccacggtgatcgtggataagcggaagctgatctttttcctgtacgcgtgtgcgctgctgttctgcctgttctcccggaactgggtcagcgtctgcaacgacatcacggagtacctgccggactccacagagacccgccaggggctgaccctgatggaggaggaattcaccaccttcggtaccgcccgggtgatggtgtcccacgtgacgcggggcatcgcggaggatctggcggaacagatcggggagatcgagggcgtctcctccgcgtccctgggagacagcatcggcgcagaggaggacggggaggccgagacgccggaggacatcgcatcgtatttcaagggcgcggacgcgctgatctccgtgacctttgcgggggaggaggatgacgaatccgccctggccgccatggaggccatccgggagctgctggccccctatgacttttatatagacagctctgtgggggattcccaggcggactccctggccgatgagatggggatcatcctggcggtagcggcggttatcatcgtgctggtgctgctgctgacttcccgctcctatgcggagattccggtgctgctgctgacctttatcgcggcggccctgctgaatctgggcacgaacttcatcttcggagagatctcctttgtctccaactctgtgacggtggtgctccagctggctctggccatcgactatgccatcatcatgctgcaccgcttcctggaggagcgggagcacgccggagaccgggaggcgtgcattgcggcggtcagcgccgccattccctccatctccgccagcagcctcaccaccatctccggcctggcggccatgatgttcatgcagtttcagatcggcttcgacatgggcatcgtgctgatcaagtccattctgttcagtatgctgtcggtgttcaccctgatgccggggctgctgatgctcttttccaaggcgatggagaggacccgccaccgcagcttcatccccaggatcgaccgctggggcggatttgtcctgaagctgcgccatgtgggagtgccgctgttcattgtggccctggtggggggctttttcctctccaaccggtgcccctatgtgtacggctatacccagatcgagactgcgcggcagaacgagtcccaggtggcggagcagcgggtcagcgacaccttcggcacccagaacgtgatcgctctgctggtgccccggggagactatgacagtgagaaagccctgctggaacggctggaggcctgcgatcaggtggactacgccatgggcctctccaatatcgaggtgatggacggacacaccctcaccgatgccctgacgccccggcagttttccgaaatgacagacctggactacgagctcgtctgcctgctgtacactgcctacgcggcggaggaggaggcctacggccggatcgtgggcggtctggacgactatgcggtccctctgatggatatgtttttcttcgcctacgacaaggcggaggggggctatgtggatctggacgaggggcagcaggcggacctggacgatctctatgaacagctcgacaacgcccgggtccagatgctgggggaaaactacacccgtatgctcatcaatctgaacctgccggaggagggggcggagacctttgctttcctccagaccatccaccgggaggcggagcggtactacgacgcggacagcgtctatctggtgggggattccaccagcgactatgacctgtccgtctcctttgcccgggataacatcatgatcagtgtcctgtcggtggtgttcgtcatcatcgtgctgctgttcaccttccagtctgtgggactgccgatcctgctgattttggtgatccagggcagcatctggatcaatttttccttccccggcatggcccagaagcccattttcttcctgagctatctgatcgtgacagccatccagatgggcgccaatatcgactacgccatcgtgatctcctcctggtacaatgagctgaaggcggagatgtcccgacgggacgccatcgtccaggcgctgaatctgtccttccccacggtactgacctcggggagtatcctgtcctctgccggattcctcatcgcccaaatcaccacagagcctgccatcgtgggcatcggcgagtgcctgtgccgggggacgctgatctccatgttcctggtcatgttcatcctgccccagatcctgttcctgggcgacgggatcgtggagcggacccggttcgatctcaaggtgccggaggttgccaggagtgcccatggcaccgtctatgtcaacggccgggttcggggccgtatttccggcgtagtggatgcccagatccagggcgtgatttacggggacgtctccggaatgctggagacgggagcttatcagaaagaggaggagcccgcccatgagacggaagattcataaatgcctgagcttccttctggcggcggtgctgctggcgtccctggcggcgcctgctgccctggccgccgaaggcggggacacggttttcgtccgcacggcggaggacctggtccaactggcagagaactgcaccctggacagctggtcccagggaagaattgtccgcctgcaggcggatatcgacctgtccggcacggacttcacccccatccccacctttggggggacctttgaggggcagggccacaccatttccggtctgtccatcacgggcagcggcaatgtccggggactgttccggtacatacagccctccggcgtagtgcgggatctgtcggtggagggacgggtcgatccctctgaccggaagaataccctgggcggcattgccggcagcaaccggggccttcttgccggctgcaccttccacgggacggtgcggggagcggacagcataggcggtcttgtggggatcaacgagagctcgggacagatcgtcaactgcactttctccggagccgtcacgggagagcattatgccgggggcatcgccgggcagaactacggcgccgttatccagtgccggaacagcggcagcatcaacaccacggaggtggatgcggagctggatctggacgccatcaaccgggaacagctgaacgcggcggaaaacgtgccggtatgcaccgatatcggcggcgtcgccgggtattcctctggtatcatccagagctgcaccaattccggcagcgtgggctatgaccacgtgggctacaacatcggcggcatcgtggggcggcagtccggatatctggacggctgtgccaactccggcgacattctgggccggaaggacgtgggcggcgtcgccggtcagctggagccggaagtgcggctgctctatgaccaggggcagatgggggagttgctggatgccctggacggtctgggggatctgctggaccagacgcagcaggatctgcggggcacttccgacgctctgtcggaccggatggacgccatctccgcccggacggacgaggcccgggaggcagtgggcgatctggcggactccgccgcggactggaccaatgagaatatcgaggagctcaacagcctcacggcccggatctcctggctcatcgaccagctggcgccgatcctggatgacgccgtcgatgtgatggacctggtggaggacctggccgacgagcttgggaatgcgctggatgaagtcggcgcggcatcagggctgggagatcaggcggaacaggagctgcgggcggcagtccagtccctccgccgggcggcctccagtggaaaagaggccgttgcccgcctgctgtcggcgctggagcatctgggcgcggccctgggcagcgccctccagagccaggaggccatggaagaggttcgggctgccgccggggacctggcagccgccctcggggacatgtccgacacgctggcagagatcgcccgcattctgtggaacggcggcgacgaagcggcgctgggagaggcggctcaagccctggcggatacactggccagggcgggggatgcgctggaacaggcggcgaacgccgtcgcggcccacatggacagcggcgagctggaagaggccgggaaggacgcggcggccgcatggcaggcactgggagaggcggctcaggccctgcgggccgccgccggacacgccaccgacgcggcagcgctgctggcaaagcttctggcacagggcggagacctggcggaagcgtttcgggacccgggcaggacgttggagaaagtggcttcccgggcatcccgtctcggcgaggacctggccgacgtcttttgggagctggccgaggagcccaccatcaccatccgtcccattgacagtgccattcgggagcagggggacgccctgggggacgtctttgccggtctgctggaggacggcgacgccctgcgggagaccatgtccgcggccacggatacactattggacgatctggaagccatcggagaccagttccgggttatcacggatctgctgcgggatctgctggagcaaactggagaggaattgtcggaccgtttcgaggacatctcggaccaggagaccagtggaccggataccggatgtgtcgccaattcccggaacacagggaccgtggagggagacatcaacgtggccggcatcgtagggtccatggccattgaatacgacttcgaccccgaggatgacctgatcgaagagggagaccgctccctggacttccgctatcagacgaaggccgtggtccgcgcctgcatgaaccggggcggcatcaccggaaaacgggactatgccggcggcgtggtgggtctcatggacctggggcgggtgagcgcctgcgagaactatggggacatcgccagcacggacggcggttatgtaggcggtatcgccggcgcctcctgggggaccatccgggacagctgggtcaagtgtcatctctccggcggcgattatatcggcggcgtggccggactgggagccaccctggaaaactgccatacgctggtggaaatcgaagagggctccgcctatctgggcgccgtggcgggagatgtggacgccgatgccgccgtatccgacaacacctttaccagtgaacgactgggggctctggatgggatcagctacgccggccatgctgaaccggtggattttgacaccctgtgcaccacgcccggcgtaccggaatccttctcccggctggagctgacctttgtggcggacggcgtggtggtagaggtcgtccccttccagtacggagaggggattgacgccctgccggagattccggcgaaaaagggctgctctgcctcctggccggatctggactacacctgcctcaccgccagccagaccctggaggcggagtataccccctacacctccgccctgacggatggcggggagctgccggagatcctggtggacggcagcttcagcagccgggcacaggtctcccacaccacggaagaggtggcctggacggacggcggcgcggagtatgcgggcaccgcctataccgtgacggtggaggacccggacctggaacaggcggcctacacggtccactgccgcctgccggaccccggcaagcggtacgacctctgggtgctgagtgaggatggctggaccaagacggatgcccggttggacggccagtatctgctgctggagagccagaccgggacggtcaccttctgcctgacggagcgggccggtcctctggcggtcgttattctggccgtcggctttgccgggctgttgatcggcttttgctggctcatccgctggcggcggaaaggcactgcggcaggacgcaaacactgacctgcggccgtgtgcggaggagacaaagcacgatatggcacgctctctgccggagaatggagatgcggtccgtatgccgcttttggggttccccggacccggtgccggaaaaggcatggcaagctgccatgccttttctgccgttcatgcggcgattcgcgtttcgcggatggctgtgcgccacgccgcatggacggacaacggccggggattctcctggcaatctctgtcctggcggacttccgccggaggagttccggcagaatgatgacaggcggaaccgggctgccggagcgtgcgttggcaccggagggaagcaggcggccccgtcagcagaatcctcgcctgggaatggcgcggcatcgcatcccggaccggacagccggggcgggacggccgcaagctgcttgtgtgcatgattgaggcggttgaaatcctgaaagttaagcggttataccggacatattgttgagaatggccctgtcttatggtatgatttggttgatcgcccacggacagggagatgccacgcttccttggcctgtccggcagaacgcctggggaatatcccggcaggccggggcaagagaaacaagtatctatggtcaatcggggaagggccgatcatccctggccgccgggcaggctctggccgctgcaaaacggcgctgccccggtctacccatcattttcaaacacgcgggaaatcctgcccgggttgaaaagagagggtaaaagccgcgcctgtccgtttcggtccgcaatgagaagggagtcctttgatccatgtctgcattcagcgaatttttcctcatgaagccggatgacgtcaagcgctatgcggcagaggttcttcaccggttcgacccggatgaggagaccacctgtacggagatcggcgacggcaacatcaactacgtcttccgggtccgctctctgcgggatggccgctcggtcatcgtcaagcaggcggacaagcggctgcgctcctccgggcggccgctggacatctatcggagcaggatcgaggcgcaggccctgcagctggagtcccggctggcgccggattacatcccggaggtctaccactatgacgagaccatggcggctctgtccatggaggatatctccgcctatcggaacctccgcaaggagctgctggcgggcaggatatacggccatctggcggagaacatctccaccttcctggcccagtccctgctgcccaccacggatctggtgctggaccgccgggagaaaaagcgccgggtgcagttcttcaccaatccggagctgtgcgacatcacggaggatctggtcctgacggaaccctactggaactacaagggccgcaacatcgttacccccgggaacgaggactttgtcaggacctttctctatgaaaatgatgcccttcacagggaggtgggcaggctccgaaacggcttcatgaacaacgcccaggcgctgctccacggggatctccacaccggctccatctttgccaacgaacagggcgtaaaggtcattgatccggaattcgccttttacggtcccatgggatatgatatcggcaacgtcatcgggaacctgttcttctcctgggccaaccgctgttttaccgcgccgcaggacacggcggctgcccgggcgctggaggataccatccgcggcgtgtgcgacctgacggcggagaagctgaccgccaggtacgacgagctggtgaccttccccctgtaccgggcggaggggttctgccgcgcgtatctggacggcgtcatggccgactcctacggctatgcgggcacggagatcatccgacgggtggtgggcgactccaaggtcatggaggtcacctccgtcacagacccggacatccggattcccatggagcgggccctgattaaaatgggtatcttcctaatccgggagcgggagagcggcctgaatggctccgctgtgaccagagctttccgcgggatactggcgtaaaggaggcggcaagatggaacgtatggaccgggatatgccgttcctgctgcaatatgagcatgtggcgtggtttgagaagggaaaagtccgcattctggaccgccgggtctatcccacagaggtccggttcgtggtgtgcacggactaccacgaggtggtacaggccatcgcggacatggtgacccagagcgcgggcccctataccgccgtgggcatgggcatggccctggctgcctggcaggtccgggacaagggcgcacgggagcaggaggagttcctgcggcaggcggcctatgacctggcacacgcccggcccaccaccgccaaccggtacggccagatcacctgccgctgtgccgatgtggcgaaggagaccctggctgcgggccgggatccggtggaggccatcgtggcatccaccgtggagtccctgaaccgccggtacagcaccatgcaggtggtgggggattatctggcgaatctgatccccaatggcggcgccatcctgacccagtgcttcggcgaaaccatcatcggcacagtgatccgggccgccaggcggcagaacaagaccttccgggcctactgcgcggagacacggccttatttacagggggcccggctcacgtccagctgctttgcccagatgggcatcgataccacggtcctgacagacaatatgatcgcctacgccatggagcgggagggcatcgacctcttcacctcagcggcggactccatcgcctgggacggccatatcgccaacaagatcggcactttccagatcgccatcctggccaagtgtttcggggtgccctactatgtcaccggcatcccggaccgggagaagcggacgaaggacgacatcgtcatcgagatgcgggaccccgcccaagtcctctcttatcgggggatccccaacacgctccccggggtgaaggccatctacccctccttcgacgtagtgccgccgcatctgatctccggcgtggtgacggacaagggcgtgtatgtgccgtatctgctgggaaactattttgactctgacgtcaagccgttctattgacggcaaagggccgccgggcggaagaattggaaaacgcagggggacggtatgccggttgcggcgctgggtcggatgccgaagagcacccccggcaggccgatccggctgtgtggaaggaatctgggtaggtcctctccgccgggagaaatgtgctctgctgcatatcaggcaagggacggaagccccgcccgccttttccggcgtgtccgcaaaaccggaatcatacgggcagctatatcagaaattaaaaatgaaaatgaaaacaggaggcagcaaattatgctgatgcaggaggaaagagagctggttgttgaatacggcaggaaaatgagcaccgaccgtctgagcacgggaaccagcggcaatatcagcgtctgcaacgcggaaaagggactgatggccatcagcccctccggcatggactatttctccaccacgccggaggacgtggtcatcacggacctggaggccaacattgtggacggcgtccgcaagccctccagcgagtgggcgctgcacaccgcgttctatcgccacaagccccacgccagggccgtggtgcacacccactccatgtactgcaccacctttgccgtgctgggccagccccttcgggctgtccactatgcaatcggcgacaccggagcagccaccgtcccctgcgcgccgtaccgcctcttcggcacagcggagctggcagaggccgccatagaggcctgcggcggcagcgacgccgttctgctgggcaaccacggcctggtggcctgcggcagggacctcaaaagtgcttacggcctggcctgtaatctggagtacgtcgcggagctgcagtaccggaccatgtgcatcggcacgcccaatatcctgacggatgagcagatggcggaggtcatggagcgattcaggtcctacggccagcccggcagcggcaaggccggatattgagcggggcggaggtcccgcggagatcttcaccagcctccggatggcattgaacacaccggcatcaaatgcgatcttgcaggagagccagccccgcgctcagcaggcgcggggctggctttttgcctgcggcggggaaagcctcctgaagcgccaaggcagacgcccctgtgaagccgtatcctgggaaaaattttcccggtctcaaaatgccgcgataccttgcagctgcccattcgttacctgttggtgcctatgccacaagattgtgcgtactttacgaaagccgcctgccgcgctaccatgggggcacagatcagaaaacgaaagggtgttctccatgaacgaaaaagcaaaaaaatacgtggacctgttccgccgggtgaagatcgcagccgccgccacggtggatgcggagggccatccccaggcccggatcatcaacgtgatgctggcagaggacgatgggatgtatattgtcacctccagaggcaagcccttctacaagcagctggtggagacgggagagatcgccctggcagccatgtgtccagactgccagtccctgaaattcaccgggaagctgcgggtcgtggacaaaagctgggtggacaaggtctttgcgcagaatcccggtatgaacgaggtctaccccggtgagagccgctatatcctggacgccttccacatctacgcgggccatggcgagtggttcgacctgctccactatcccatcagccgggagacatttgcctacggcggggacacggaggagtacaacggctttgtgatccaggatgcatgcatcggctgcggcgcctgtgcctcagcctgtccccagaagtgcatcactcccggaacgccctatgtcatcaactgggcgcactgcctccagtgcggccgctgcgcggaggcctgtccggcagacgcagtgcgccgcctgcacccgtaagcggctcatggaactgctgcaagggattttgggcctgtacgcccagcgggcagactggttcgcgggattgctgcaggcccacatcggcctggctctgaccgccatcgccatgtccggcatgatcggtcttttgacaggcatctggatcgcggagcatccccgtatcgcgccgccggtgatgggcgtctgcaacgtgctgtacaccattcccgccatctccctgctgggcatcctgatccccttcagcgggatcggcaacaagactgccgttattgccctgacggtttacggcatcatgcccatggtgcacaacacctacgtgggactcaccacactggacccggatattctggaggcagccaggggcatgggcagtacggggacacaggcgctgtttcgggtgaagctgcccatggccgccggagtcatcctggcgggcgtgcggaacatggtggtcatgaccatctccgtggctggcattgcctcctttgtgggggccggtggcctgggcgtggccgtctaccggggaatcaccatttacgatccggccatgacggcggcgggcagcatcctgatcgccctgctggccattgtctgcgatctggcgctgggcgcgctggagcgctatttcaaaaagagaggaagctgaacttatgaacatcctgaatcgactgcaggcggccgtcctagccatcctgatgctgggcaccctgaccggctgcggcggaggcgccgcctccggaggggagaccggctctggcgaccctgtccggatcgccaccaagcccatgacggaacagtacatcctgggagagatgctgggccttctcattgagcaggccggctatgacgtggagatcactaagggcgtgggcggcggcaccagcaacatccagcccgccatggagagcggagagttcgacctctatccggagtatacctccagcggttgggtactggtgctggaccaccaggccgagggtgtggatgatgcagagatgttcacccggcttcagcaggagtacgaggagaagttccacatgacctgggtggggaagtacggcttcaacaacaccttcaccgtcgccgtccggggcgatgtggcggagcagtacggcctggagaccaccagcgacctggccggggcggccggtgagctgaccttcggcggaaacccggactatctggagcgggaggacggctttccaaccctgtgcaagacttacggcctggacttccggaatgtggtggacatcgacatcggcctgaaataccaggccctggccggcggagatatcgacgtgaccaacgccttcaccaccgacgcccaactggcgaatccggacacagacctggtgacgctggaggatgacaagcatctgcaggtgaactacttttgctccacggtggtccgccgggacgcattggaaaaattccccggtctggaggaggtgctgatgcagatggacggtattctctcagacggggagatggccgcgctcaactaccaggtggaggtggagggccgggacgagcgggatgcggccagggacttcctgctccagaagggcctgctggaggcgtgatatgacccagccgatcattcgctttgaaggcgtctccaaggccttcggcacccagaccgttctgcgggacttctctttggatgtggagccgggcgcatttgtgtcgatcatcggccggtccggctgcggaaagaccaccgtgctgaagctggtaaacggcctgctgtcgccggacacgggccgagtcctgatccaggggcaggatgtggcccgaatcgacccggtggccctgcgccgccgcatcggctacgccatccagaacgtgggcctgtttccccacatgaccgtggagaagaacattgcctatgtgcccgccatctccggcatggaggaatggaaggggaagcagtgcagagaaaaagtcgctgccctgctgaagcaggtggggctggacccggcgctggcggggcggtatccccgcgccctctccggcggacagcgccagcgggtgggcatcgccagggcgctggccgccggtccggagcttctgctgatggacgagcctttcggcgcggtggacgagatcacccggggccagctgcaggatgagctcctgcgcatccaccgggagagcggcatcaccgtcctgtttgtgacccacgacatcgcggaagccctgaaactggggacccgcacactggtgatggacgccgggcagatccagcagtatgacgcgcccagccgcctcctggcgcacccggccacgtcctttgtggagcggctggtccgccgcagccgggtgtttcagacccgggcgtaacgtctccggcagaccggccgtccgctggaaatggacaaaagagaaaagaggtccgaaggacgtacgtccttcggacctcttcgcttatggggatcagcttgccagcatgctgggcagccaggtgaccagcggcgggaacaccgcgcagagcgcggtcacgatacagatgatgataatgaacggtataacgcccctgtagacctcctggattttgatgctcggaggcaggatgcccttcacatagaacagggcgaagccgaagggcggcgtcatgaagcaggtctgcagcaacgtggcgctgacggccaccagccacagccggtcgaagccgaaggtatccatgatcggcaagaagatggggaacacgatcatgacgatgcccagccagtcgatgaacatgcccagaaggaacatgatgaccatcatgatggcgaaggcgccccacttgccgatacccatgctcaggacccagtccgcgatgatctggtcaccatccagagacatgaacacgccggtaaaggcagctgcgccgaagaggatgatgaacaccatggcggtggttttagcggtgtcgatcagagactcatagagcatcttccagctgaactgcttgtagaagatcgccaggatcagggagaacagggcgccgatgcccgcggcctccgtgggggtggcgatgccgccgaagatggagcccagcacgccgaagatcagaatcagcggcgggatcaggttgatcagggagccggtgatgcgcttcttcaggggcatctccgccagctcctcgggactcatggccgggccccagtcgggatggatgtggcagaccaccatcaggtagatgatgtatcccagggacaggctcagaccggggaccatggcggcgaagaagatcttgccgacggagacctctgcgtaagagcccatggagaccagcatgatggagggcgggatcagaatgcccagggagccgccggcgcacaccatgccgcaggccagggagggtttgtagccgctgcgcagcagcacggggagagacagcatgcccatggtgacaacggaggcgcccacgatgccggtggtggcggcgaacacggtggaaaccaggatcacggccagacccagtccgcccttcaggggccccagcaggtaacggatggactcaaacaggccgtccgccaccttggagtgggtcaggaagttggccatcagcacgaacatagggatggccaccatggagtagctttgcatctggtcgtagatctttgtcatggcgatggtgacgccgggggtaccccaggccagccagccgacgatgacgccggcgccgcccagcacgaaggccagctcctggcccaggacaaggcccacgaccatcaggccgaacaggccgaggatcagcgccacgccaagcgtgccggcggggatctcagcggctgcaaccagcccctgcagttgttccaaaatcgcagtcatccctgcgcctcctttccgttcgcggaagccgtgacgagtccctccacatgcttgaggatctcagagacggcctggatggcgagcagcaccagccccacgaacaggcagagcttcaccggccaggtgggcgcggcccacacggagtaggtctgctcaccggtggtatacgcgttcaggaagaaggtccagctggcgggaacgagacccatcaggaaggggaccaggaagatcgcgtatgtgacgatatgcaggatgtgctggacccggacagggaacatggcgtagaccacgtccaccgccacgaaggcctttttctgaaggccgtacgcgctgatcagaatgatatagcaggcgaacagcatcacgatcaggtcctgagtccagatctgcggccggttgaaaatacggcgcaggatgacctcgcacatgatgacggcaaggattgccagcgacaggacggagaagatccggcccaggaagtcgttgaacttgtcgatgccattgtagattgctttgatggctttcatcagaaattcacacctctttcataaactctctcatcagttgttgaagaggcgttcattcgccgcggttgaagccgaagccgtagtcgccggtccagtcgcggtagttgttggcagtctcacggtaggcctgcatggactcatagaccatcttgaagttggggttgatctcgcactcctccttataggtctcgatgcaggtttcgcggataagctgcatgtcctcgtcggacaggctggtgaccgtgacgccctgatcctcgatcatctgattggtgacggtcatatcattgtagatgtaacgggagagctgctcaccgcagcagaggcgggcggcgctctcaaaggccacctgataggcctcaggcaggctttcccaggcctgtttgttcaccatgacgccgttgacaccggcggactgataccaggcgggggcgcaccagtagggggcgacctcctgcagcttcagggagtcgtcggccttggggccggagaactcgccgccgtcgatcacgccgcgctgcagggactcatacagctcggaggcggccacggtggtgatgttgatacccagcttctgcgctgccttgccggccatgacgccgcccaggcggatcttcatgtgctgcatatcctcgatggaggtgatgggggacacggagcggatgccggactcggaggggttggtaaccagcgggaagtactccatgttgtactggccgtacatctccttatagcagtccattccgccggcctcatagatccaggtgtagtagtccagggcggtgaagtcgtccatgatagtggacagcagctcaaaggccgtgtccttgccggaccagtagccgccccagtcgccgccgcactccacggtgccctggctgacaaagtcgaacagctggctggcggagcacagttcgccctcggagtaattggtaatgatgaaccggccgtcggtcagctggctcaccagctccgcgaagcgctggtccacggtgaagtggacgttaccagcgccccaaacggaacccatcttccaggtcacgacaggcaggctgctgtcgccgccggcagcggtggcgttcagattcgcggtgtccatgatgccgctgtcggcagatgcgcagccggacagcagcacggcgggcagcagcagcgccatggtcaggaacagtgcaaaaaatctctttttcatttcgctttctccttggtctttcctaatttcacacaggtgcagggggaagtcactcagttccggggatcgccttctttccgttggccgcagggccgtattcaagaagctcccgctgttccgccggggagcgcgggagaacatcttccacaagctgggccgcccatattctggcggcggacatcaaaagagcccgctcttttctgagagtcggctctgcttgaccggaggctcctcgccgcgcttgcgcagctgcccgcgcaggcggctcagagacactggggacatacataaaaaggatgcgatgtgcttgatgctgaccacgtccgccagctcgggatagcggcggagaaaccactggtaccgctccatggcggagctgatgccgagaaggagcttcagctcccgttccagcttcagtttctccagcaggtaagaactatacagctgctgcagctctgcggactgctggaactgctccgcaaggagctgggtagggatggacaagagcacacagtccgtcaacgcctcaaagttgatcgggaaggaagctgtcaagatgctgagactcagcacggcctctccaggccggtagaggaagcaatccgtgatatcccgccctttttcatccgtcaggtaaccccgaatgactccgctgaccagaaacgggatccagtcagagcaggcgtccggcttggcgacaagctgcctctttttgcaggaaaaaagccttgaggcatctgcgagactggcggccagatctgtatcctcaaggtggaggatctcctccaaacaatcctgaatatgcatcgcatcttcctttctttcgccacaattatacaaaattgcagggaagattgcattaacacaggttaatttttctgtcctcaaacagaaaaaagttaacattttattcaaaaattttttaaatgcaagaaacggatgacacacagaaggctatcctgggaatcacctgggtggagagcggaatttctgttgaaaatctattgacatcgtgtcagaatacggctataatgcagatactgacactatgtcaataaggagacctgcaatatgagagcgaatgtctatttcacaagggagatcacgcctgaaaaagtagtggagctgtatcgtgccctgggcgtggagctgcccggcaaggtggccgtgaaggtccactccggggagaagggcaaccagaatttcctgcgtccggaattctggtgtcccatggtagaggaggtccacggcaccatcgtggagtgcaataccgcctatggtgatgcggccggcggtgtccgggatcatacggagtcccaccggaagctgctgcaggagcatggctggaccaagtacttcgacgtggacctgatggacgccgagggccccgacgtggtgtggcccatccccaatggcaaggtcctgaaggagaaccacgtgggcaaacacatcctgcattatgactccatgctggtgctggcccacttcaagggccaccccatgggcggctacggcggcgccctgaagcaactggccatcggctgcgcctcccgggcggggaaggcgctgatccactccgccgggaaaaccgatgaccgcttcaagacctgggagcagcacgccagctccgtggtctttccagaggccatggcggatgctgcctccagcgtgatagagcactttcggggcaagattgccttcatcaatgtgatgaagaacctgtccgtggactgcgactgctgcgccgtggccgaggatccctgcatgaaggacatcggcatcctggcctctctggacccagtggccatcgaccaggcctgtattgacctggtaatgcaatccgatgatccgggcagggaacacttcatggagcgggtgaacagccgcaacggcatccacaccatcgaggccgcagcggaattgggcttcggctcccgggcgtatgatctgaccgaactgtaagcattgaaaggagcaacctgcaatgagcaagatattgatcgcctatttttccgccagcggcgtcacggcccgcacggcgaaggagatggcaaaggccgctggagcggatctgtatgagatttgtccggcagagccctataccgctgcggacctgaactggatggaccagaagagccgcagcacgctggagatgaacgatccagcctgccgccccgccatcgcggcaccggcggcggatctggaccagtacgacaccgtgttcgtcggcttccccatctggtggtatgtggagccccgtatcgtggacacgttcctggagagatctgatttttccggcaagacggtgattcccttcgccacctccggcggcagcgggatcgagaaggcggagcggagcctgaagtcccactgtccccaggccaactggaagaagggcaagctgctcaaccacatggatgcggccgcctggaccaaaagcgtgctgaattcggggtgctgaagcgccggggccgcaggacaccggccttgagcaggcgttcccaatacccggcacatccggctgggtgagagctgtggacggacgccccgtgttctatttgacacagcgatgggaaaccggtatcatgtgtttgaacagcactgggaccataggcgcggaatgcgtgccggaaacccatggaaacaagagagggaactgccatgccgagaggatcagaagagctgacgaacgcgcggaaagcggagattgtcaatgcctgtgccgtactctatgagaccaggagcttcaaggagatcacgctgaaggagatcggggagaagacctctttcaccagaacgtcgatctataactatttccagacaaaagaggagatctttctggctctgttccagcgggagtacgaggcatggatcgaggatctggacgccctgcgctgcggacaccggaagctgtccgtggatgctttctccgacgagctggcccgcacactggagcggcgggagcggctgctgaagctgatggccgtgaatcactatgatatggaggccaacagccggatcgaaaatctggtggcgttcaagaaggcgtatggcggctccctgctggccgtgacccactgcctggagaagtttttcccccggatgacggatgaggacgtgcagggattcctctatgcttttttcccgttcatgttcggtatttacccctataccgcagtaacggagcagcagcgtacggctatggagctggcgggcgtcggctatgtccggatttctgtccgggagctgacgcggtcgtttaccgccaagctgctgcagggatttcaaatgtgagggaggaggtccgccggacccggcgttccgtttcctgtctgaatgacagccctgcgccggaccggcgcggggctgcttttcttgggtggaagcggcggaagactgtggggatgccgccttcccgacaggagctgccgggaagggagctgaaatcctggagggccggttggaagcacccggacgctgcggcccgctggcccatgcgcccgcctccaatcaagcatagaaggccgcccttgtaggtgcccgggaccgtttctcaaaccggaagggtgccatgatccaccccggtatgttaccgaaaaagactgcggctccgcattttggggtttccattttgggaaaattgggctatgatgaaacaaaatgggccccgataccagcacagggcagaaaggcgttcctatggatatcaaacagttgtattattttacggcggtggcacaggcgggcagctactccaaggcagcagagagtctggcggtgtcgcagcccacgctgtccgtcacggtcaaaaaactggaggaggagctgggtgttcagctcttttacgccttcaaccgggagcagcacctgaccgacgagggtctgcgcctgtggaccaaggccaagcagatcctggacctgtatcaggagacgctggacgatatgaagaccaccaacaaaaacagctccggcaaattcaccctgggcctctctccgctgttcggcgcctgctttttcggcgacttgatccccaatttctccatggagtatcccaatattgagatcaagatgattgaggacggcgcctaccgcatcgaccagcggatcgagcgcggcgaggtggatatcgccgtcacgctcaattccaaacgcctgtcctcctttgcttactgtcatttttccacccagaggaacgtggcgctgcttcacaagagccacccgctggcgaaggagccctccgtcacggtctcccagctccgggatgactctttcgccatcttcaatcaggacttcattctccacgaacagatcgtggacgcctgccatgcggccggtttccggccgaaattcgccctgctcagctcccagtgggatttcatggtggagctggtgtcaaaaaaccatgcggtttccatcctgcccaagccggtgctggacaagcatccggatcccaacgtgtgctgcgtgcccatgagcgacagcatgaaatactgggacatcgtgctggcctggaacaaggacaagtatatgccgaaagcctgcgcgctgtttctggattactgcaagcaccatctcccgccggatgacctttaagacgggtattgaagcgagctattattttttataataatattttttgaataatattatagaattggaattttacaataaaaattctatataatttttgataaattaaattattaaaatttatatattcttccgctatgataaacattggaagcactgccggccggcggcttttctgtgtgaaccccggatccgtccagagttgtagcctggaccagatctacattctgatagcgggaggaagaaagcctttatgttaagtttggttggcattattgtcggccttgcgctgctgatctttttggcattccgtggaaaatccctgctttgggccgctcctgtctgcgcgctgctggtggccttcaccggcgggctggacatgtttaccgcctatacgcagaactacatggagggtatggtcggcttcgtcaaggagtggttcccggcgtttatgctgggcgcgatttttggccagatcatgcaggattccggcggcgcggtctctttgacgaaagccgttgtaaagctggtcgggcgggacaaagcgatctttgcctccgtcctgtgcggcggtgtgctggcttatggcgggatctcaggcttcgtcatcattttctccatgtatcccattgtgctggggctgttcaaggaggctgacattacccggcgcctgattccggccacgattatgaccggcgcttttacctttgccatgagcgcgatgcccggcacgccgacgatccagaacctgattcccacagagtatttcggaaccaccgccacggcggcgcctgtgatcgggattgtgtgcaccatcatcatgttcgtggggcctgtcctgtggctgagctggcgggccaagaagttccgtgccgcgggcgaggggtatgacgaaccggatgagatgccggaggaggtgccggacgataagctgcccccggcctggtgctgctttatcccctttgtggtcattgtgatcctgctgaatgtgttcaagatgaacatcgtggtgtgcctgctggcggggatcctgctctccctggtgttcctgttcctgatgggaaaggtgcggggcagtgtgtatctgaccaatgtaggtgagacctgcaacaagggctgccagagcgcagtgtccgccattatgaacaccgcggcagcggtaggcttcggctccgttgtgaagattaccccgggttttgcgttcctgtccgagctggttttgggaatcggcggcagtcccctgatcgcagaatccattgccatcaatgtcctggctggtgccacaggctccgcctccggcggtctccagatcgccctggacgctctggcggataactttattcagatgtcccagacctccggcattcctctggcggtgttccaccgggttggctccatcgcctgcggcggactgaacaccatgccccatgacggcgcggtggtcacctatctgtcctactgcaagatttcccacaagcgcggatacttcgatatgttcatagtggccggcgcaattcccatcctggccaatatcgttgccatcattctgggtaccatcggcatcgtctgacgcttcggacgagatcaagatacaagataaatgattgaggaggaaatcatgatgactatgaaatccgcattgattaccggtgctgcgtccggtatcggcaaggcctgcgccgagcgcatggcgcaggaggggtacggcgtcgtggtggcggatgtgaatctgcccgctgcggaggaactggctgccaaactggcagcagagggcctctccgccatcgccgtccacatggatgtggccgatgagcaggaggtggaggctggttttgacaagatgatggagacctacggctcctgcgatctggtcatgtccaatgccggtgtgcagatcgtccacccctttgaggagtatcccttcgcggactggcggaagatgatggccattcacgccgacggcgccttcctggtgtcccgggcggcttaccgccggatgaaggcctccggcaagggcggccggatcgtgttcaccggctccgtacagtccttcgtgggctccaagctgaaagagccctacaacttcgccaagcacggcgtggccggactggcaaaagccatcgcccgggagggcgccgagtacggcatctacacctataccatctgccccagcttcatcaagacgccgctggtggaaaagcagatccccgagcaggcggcttccctgggcattacggaggaggaagtggtgaagaacatcatgctgcgggataccgtggacggggtgttcaccacggtggaggatgtagccaacacgctggtattcctgtccaaggatcagggcgctctgacgggccagtccctgcggctgacccacggctgggccatgatgtaatagaatcataggaatcataaaaggaggcagctatggaacgaattgcggtttatggagcgggcaccatcggttcctgccaggccacgctcatcatcggcaacggcctgccctgcacggtcatcggacactcggagcgggggctggagcggtgccggaagtccatcgagcagaactgggatgacctgatcgccgagggcctggctacggagggcaacaagcaggccgccatggccctggtcaccatcaccaacgaccctgccgctctgcaggagcacaccttcgtcttcgaggcagtggcggagggcactgaggagaagcgggccgtctatgagaccatcgagcagaacgctgcgcccaacgtggtgatcgcctcctgcacgtcctccatcgacgcagagatcctggcggggctggtttcccacccggagcgtcttctgatcgcgcatccgttccagccggtgcacatgctgcccctggtggaggtggtgcgccacgaaaagacggcggaggacacagtgacccgtacgctggcgctgctggagacgctgcaccggcaggtagtggtgctgaaccgcagtgtgcccggcttcctggtgaaccgttttgcccaggcgctgttccgggagtccatctacctcattgagcagggagtcaccaccgcggcggacattgaccgggcggtgaagtacgccgtgggaatgcgctatgcatccatcggcctgctggagtatttcgacgccgtgggatacgaactggagagcgccattgcaaagaacgtctatccggacctgtgcggcacccgggagctccagcagctggtgctggacggcctggccaccggcaagaccgggcaggcggcggggcagggcctgtacgactggtctcagaaggacgcggacgacttccgccgccgtaagcagagcccgtactttgcgggcgttaaagagtgggccatgcccgatgtgaagtgaccgctcgcagctgattcaaaagcagaaggacaggcatccggaatctccggatgcctgtctttttggaaagaggggagcacactgcggcgtgccgggctctttgcacacatgccgtcctgcctggaacggttttccactttccggatacggagccgcctgatcccacaggccggattcggagaggaggacaattgtttccatcaaaacgaaaatattactgtgctttaattggtgaaaagtaaaattacattacaggaaattcacccttctccgatgcggcgcggacggaggcggcctgttcagtgctgccgctggccctcgggccgaaccgccagcaggaccacgccgctcgccagcaggacgaactggacgaaaagaacggccgccggcagcgtaaacgccgggtccagtgtccccagggtcaggggatactgggcgaagaggcgcccgttccacagccccagcgattccggcagggggagcgccagacagacgggagaaaccagcatccagacatagagcagccagggccggagcattcccaacagccagccgctgcccagtgcgaacaccagcggagggaccagtgtgaccagcgtgggaaataccaggccgctccagccataccagccgaaatagatcccatagaagcaggcggcttctgagatgcaggccagcgccagcagggcggtgccggtcagagcggcggcgcaccgggccagggcgtaccggcggggcggaaggggagccgcgtctgtgagcactgctgcccgtcgggctttttccgaggtgaagaaggtcaggaaaaacagcgccccgatccagagcagcgggagcatccggctcagaaagtccccgaagctccagggggaaaaggggcggtgtgggacaccccgaggatggtcacgcgccgcagcacctgccagccgtagaacaggagcaccagcacaagcccggcgaaaaatttgttccacagcaggcgcttgcactcatagagaaaaattttacgcaaggttcaggtcctcctctgtcagcccgcaggcgtttaaaaagtcttggtaggtcagatagggatacatgggatccagctcccggttgaacaggccgcggaggatccggtccatggcctcctcgccgccgaccagttgctccgctttcaaaatcttcaggggcatttcgcagtactgccgcacatagcggaggctattggagatctccagccgctcctcttcgggcagcgcctccaaatagtccggattgcggacatagaagttcaggtaatagttgtccaccgcctgctgccactggtccacatagtgctcctgtgcgtaggatgggccgtatcgctccttgacaatacggtaggtggtgtagaccgtcaggccctctgccgaccaggggctgctttcatccgacgcatcaaacatgtttccaaggccccaccactgatggaccagttcgtggatcatgacttctccggctccgccgcccttgccggtatcgctcagattgtcggcggtgaagtctgcctcgtccagcagactggcgccgtttgcggcgtagccgccgccggtcacccggctctgaatgagcttcagggtatcgccgctgccgaaggacaacatgccgtagtgcgctgtacagtagtccaccaccgacttcacggcctccgccgccccggcggcctccatgacggcctgatgcttgcggccgtagtagaattcgatgtccatgccgccggcctggatatcctggcggatgtagtccccggcatagagaatgccgccggcgctgttggagtcatagcgccaggtttttgtgccgtctgtctgttctgcgacgacctccgccttgctggccccgaaggggatgaccgacatggatgcgggaagcgtgatctcgatggtggtgggataaccgttttcccccggcagcacgttcatcaggcggggagacaatccggcattttccaggcataggtattcagagctgatctccgtgccgccctgcatgatggacacattccggttttcccggggaaagccaccgtagtccatagtcagttcgatctcccggtccgacgggagggccacctccagcatggcctcgttgtactcctgatagtcgctcacagagaagggcacttcggcgccgttgacccgcacgttggagatggtatagcccggattgacgccgaaggccgctgtccacgcctgcccggaggtgttccggaaccggtaggccgccgtgccggagaccgtcccagcggtggtgtccgggaatacctgggcgctgcggctggtgcagaccacattctccgcatagggaacctggtagaagtccataaccgtctggtcggggttgctgtggtccaccaggggctgggcggcataggcaaagccggaacaggccagaagcgacagggcgatgataggccggtgggcccgccgcacgctccgggccagggagccgggcagccccttcccgtactgccggatgcagagatacgacaccgtccagatccccgccagggccgccagccaggtgagccgcatccaggctacggaccgaaagatgcggaaattggagaaatcgtccgacagcgcccacacgcaggggttcagccagcagagctgccagttgtccgcccagacagtcaggctcaacgccgcaaaggcggcaaagagcaccagggacaggtccgcccgccgggtatattgataggcggcagaggcagccagaatagacagcgggagcgccagtcccatgaacagcaggtacgccaggacatagtcgcccccgtcaaagatggagccgatcagcccacagctgatgggaagccacaccagcatggtgaggaccagcgccagtccggctgccgccagcagggccggcaggcgtaccagcgccgcagctagaggagaaacaaccgcattggtgagcacctccacacggctgcggccggcccggtccagctcatatactgtgagcaggccgaagagaataccgcccgccgcccctccggccagggccggattggccaggtacatggagagcatggtgctggcaatggccggcttgtagaggacgagtcctactgcgggggagatgacggtcagaagaacgatgagccaggtcatgcggctgtgcagaagccgtcccagctccagggggaacagacgcaggagcttcattgtaccgcctcccgtgagatgagatagaggtaggcgtcctccagagacggttccgaccgctggacataggcgggcagcgcgtccgccactgcgcggcatcggacgccctggctggtgttgacccgggcggtgatgtgcaggccctgctcctgaccggcttcccgttcccagaacacgcccacatggccctctgccgcctgaatcaactgctccggcgtgccggtgaacaggatttgcccgtggtcgatgaccaccagccggtcacacaccgactgcacgtcctcgataatgtgggtggacagcagtaccagccggtcctgggccgtgcgggagaacaggttgcggaagtggatgcgctcctccgggtccagccccaccgtcggctcatcgaggatcaggaggggaggggcgcccagcagggcctgggcgatgcccacccgctggcgctgtccgccggacaggctgcggatgcgggcgcgggcctgcccctccagattgaccgtccggatcacctcgcggacggctgttccggagtcccgcagccccttcagggcggccatatagtccaggaactgggccacggtgagctcgttgaacaacccgaaatcctggggaagatagcccagctgggccttcagctgccgctccgtcttgagaaggggctgtccgtccaccagaatggagccggatgtggggagcagggcggccaccagcagcttcatcagagtggacttgcccgcgccgtttggccccagcaggccgatgaggctgggagaccggagctccagactcaggttctgcagggcctgttttccgctggggtaggtcatgctgacgttttgaatgttgatttccatgtgatcgggatcctttctgcttgggatacggaaaggataccatggctgtgtggaggggagttggagattatgtgtggtttgtgtggagaagcggacaccgggaaatatcctgccaaaaaggttcgccgcagaacatttctgttttgcggcggactcgttttcttccatatacattggcggagcagtcagggatgcagggaatagaatttgttcaggcgctcggccagcgcctttgggttttcttcattcacaacatggccggtatgttcgataagctgtaattccgcgccagggatgttctgcgacaggtattgggcggagcggatattcgaacggtccttttccccgcagatgatgaggacgggacaccgcataccgcgcactctgccgctgaaatccagcttcttcatggaattgcccaagacaaacgtgctctctttatcaaaggccatggtgtcaaaaacggatctgggcagaaagcggaaaatcaggttttggataccgaacgccgccttgggaattttatgaggcgtcccgatcaggaccagcgtttttaccttttcggggaagtccagcgcatagttcagcgccaggataccgcccagtgaaagaccgcacagatggaccgctctgccgacgtgatcacagtattctgcaaacgccccatagaggctcggatagcttgctgttttcccggcaagcagggcacacaggtccggacacagcagctcctctttgccatccatgcaggagaccgtttccttccagcttgccgccttgtgtccagaaccatgaaccaggatttttttcgccatacgcaacctccttggcctgatctatgcagcttctccgcttgtacgatgtctcagcgtatacttgaaacggtcacatctgcggaagaaagtccggaatgggcagaaaactaaaaccttacagtcgcttttaccccttcctccgtattctcaatggtacacaccgcgccgtgccggtccaggatcattttcaccagatagagccccagtccgctgccgccggtgctccggttccgggaaccctcctcccggtaaaaggcttcaaacaggtggggcagggcatctccgctgacccgcgctccggtgttctccacactcagggcggggcggccctccaaccggccgcaccaaacccggatttccgccccctccggcgagtagcgggaggcgttggagagcaggttgcccacggccttccccagcagggaggcgtctgcgggcacggtaatccccggggtcagtgcggacaccagctgctggccccgctgctccagcagctcccggtccagagccagttgctgcgccatcagggcggacaggtccacgggctcctgccggacggcggcagatccggactccatgcgggagatggacagcatctcgccgatcaggcgctccatccggccggttgtctggagagagcggagcaggtacttgtcccggtcctgatatacgccgacgccctccagcatcccggccagctgtcccttcaaaatggtgacgggcgtcttcagctcgtgggaggcggcggagaaaaaggccatccgctgtcggtccagctcccgctcccgggccacctccccccgcagggcctggttggcggtctccaggtcggtgagggcggcagacagccgccgggccattttgtccagactgcggcccaactggccgatctcgtcccggcgccgctccccgcacacccactggaggtccagctccgccatcctgccagcgatgccgttcagccgcacgatgggccgggtgatataccgggagtacccgaacgcacacagcagggagaaggccagcagcgccagagccagccagggggccacccgccccagggcctccaccgcctggttggccaagcggagctgaggggagaccagcagctggtaggtcccctcctggtcggcaaaggtgatctgggtggtgaggatccccgtctgagtggcggtcaccacaccgtcggcccggtcaatctgcacctgataggtgtcggcctcataggtctggaccgagttgtccgccccggacatggtgacggccacctgccagtcctcctccggcaggaccaacagggagccggtgtccgcctccgccccgccgggggccgtcagggctacctccgccccgctctcccggacaaaggcgtccaggatgggccccgcgtcggccagattggtctgcgccagctgctgggtgaggtcggctacctgggcctggagccggtcgctgatcacagcggtgtaggtgatgggggtggcccaggcaatcagggcgaaggtgagtccccctgcccccagcagcagcaggaaggtaagcagaaaaatacgcaccgtcaggctttcagcgagtttccttcgcagcacggtagcccacccctctcacggtttcaatatagtcccgccccagcttgtggcggaggtttttgatgtggctgtccaccacccgttcatccccgaagaagtcgtagccccacagcctggagagcagcatctcccgggtgaagacccgccccggcgcggccagaaaggtgcgcagcagctcgaattcccgggccgtcagatccaggggacggccgtccagtgcagcctccctggtgtccaggtccaccaccagatcccggtaatgcaggcggctttccgccgcttcgccgctccggcgaaggatcacccggattttctccagcaggaccggcatggagaagggcttggtcacgtagtcgtcgatattcaggccgaagccccggagctgctgcgtctctccgtccagagccgtgagcatcagaatgggcacctgggactggcgtcggatctgcgcgcagaccccgaaaccgtcgattttcggcagcatgatgtccagcaggaccaggtcaaaagactgggcgcggaacaggtccagggccgccgcgccgtctccggccacagcggccgcatagcccgcgtcctgcagataggcgcacagcagctcctgcagctccggctcatcctccacgatcagaattcgtttcatcaacaatcaccgggaaaaagtatagcacaggattgtgaatttatcatggagaatttcatttccccctgtgtggggaacagacctccgtttccagcagcggccgcctgctgcgtgaccggtcccattgaccagtgggcaccggagctgtgacaggacgattcccagatccggttcgtgggctttgacttcttctgcatccaggtgttcaacccgcgtgaaaactccaaggacatgatgaccattgacaaccgacagaaatgtgaactcccggctgaaggccctccccgtggactggaactacaccatccccttcggcccgctccacgcccacgggtccgcagttactgtcaaacggttcctgagcgcggcgagggcggtattttccctttgatcccgcttcacgggctgtaacggaaaggtatatgcccatagcttttgaggcttctccggaaatctcaattttttataatagccccagaacggccgctatgcgggaagagaacgatacataatttgatttttgaaaatgggacgcggttcatttccggggccaggtgtctgaagaaatatctggccagctttttgagaaaaacggatcgaatatgctgctggtcgcagacagcagcggtggggagcgggacgcggagcacgggacgaagtgcccgccaggtccacctgccctgccccagcagcgaggcggcaggcggcccgcctgtgccgaaagcccgcctcgggggagtccaccggctgacccgaaagaaaaaaagagcggcatatccctatggatatgccgctctcctctgcgcgaaggcgcaccgggggagaccgtttccgcccggtgcgcgtttcttatgggatttcctccggtgcacggagctatccggctgctcggggcgtcagttctccaggtcctcctgcagggattccaccagggcgtccgccagctgatccagctctgcggccttgtccgcctgaagggaggaggccagggacagccgctcgttgagcaccgtcatgttcttgagttcctcgtcgatgaaggcctgcatcaggtctccggacttgcaggcccaggagccgttctcgatgatggcgaaggtgcggttctggaggttcagggccttcatgtcctccagatagctcttcatcaccgggtagatgcccagattgtaggtaacggaggccaggacgatgtggctgtacttgaagctttcggcaatcaggtaggacacatgggtgttggacacgtcgtacagggccacgtcggtgatgccccgttcgcaaagcttggcggccagcgcctgggcggctgcctcggtgttgccgtacatggaggcgtagacaatcagcacgcccttgacttccggctcatagcggctccatttgtcgtacttgtcgatgaagtagcccagatccttccgccacacgggaccatgaagggggcagatataccggatctggtccaggatgccgccggccttgcccagcagcagctggatgtgggggccatacttgcccacgatgttggtgaggtaccggcgggcctcgtcgatccagtcccggtcgaagttcacctcgtcggcaaacagcttgccgtccagggcgatgaaggacccaaaggcgtcggcggagaagaggacgccgttggtggtatcaaaggtcaccatggcctcgggccagtggaccatgggagctcccacaaaggtgacggtgtggtcgccgaaggaataggtgtcgccctccttgacctggatgcactcgtgaccgtccacatggaagccgaactggcgcatcagcatgaaggccttctccgtggagatgatccggaccttgggatagcgcagcaggatctcctcgatggaggcgccgtggtccggctccatgtggttgatgaccagatagtccagaggcgttccgttcagcaggtattcgaggttctccagcagctggcggcaggcggaccagtccaccgtgtcaaacaggacgctcttttcgtccagcagcagataggcgttgtagctgacccccttggggatggggtggatgttctcaaacagagccagacggtggtcattggcgccgacccaatagagattttcggtaacagttctcacacaatgcatgcagaaatcctcctttactcacagatgacaggccgttacgcctcaatgaactggtccttgggctccgcgcactccgggcagacccagtcctccggcagcttttcaaacaacgtgccgggggcgatgtcaccgtccgggtcgcccagctcggggatgtactcatagccgcagccgccgcagacgtatcgcttgccgatgggctccggcttggggagacggggccgcttcatcttcaccatgggcggcgcgggctgcttttcgccggtgtccagagcagcggtcagcaggggcagaatctcgttcacatccccaacgatgccatagtcgcagtttttgaagatgggggcgccggcgttggtgttgatggccacgatggtagaggcgtccttgatacccttcaggtgctgcaccgcgccggagatgccgcaggcgatgtacaggttgccggtgaacttctgaccggacatgcccacatagcggttcaggggcacgtatttcagcgtctccgccaccggacgggaggagccgatggccgcgccggcggccttggccagatcctcaatgagcttcatgttcttcttgccgccgatgcccttgccggcagagaccacccgctccgcctgggcgatgggggtgtccagggggatgcccacagtgaagtcgtggccgtccttcttcaaatgctccaccagggcggccacctgctcggcgggggagccgtcccgcaggatgaccttcttccgcacaccggtgacgggcgcgggcttcttgggctggctggaggaaccgccggaactcttgggggccttgcccaggatatgggaggcgatgaccacccgctggatctcgttggtgccctcgtagatggtggtgatcttggcgtcccggtaggcccgctccacctccatacctttcatgaacccggcgccgccgtgaatttgcagggcgtcgttggtgacctccagggcgatgtcggaggcgtacatcttggccatggcggattccatgccgtagggggcgtgcgcctccttcagctcggcggcggagtacaccaggaaccgggcgcagcggagcttggtggccatgtcggcgatcttaaaggagatggcctgctggaagccgatgggcttgccgaactggatgcgctccttggagtaggccacggcggcgtcataggccccctgggcgatgcccagcgcctgggccgcgataccgatgcggccgccgtccagggtggacatggcgatcttgaagccgtcgccctccttgcccagcaggttctccctgggcacttccacattgtcaaagatcagctcggcagtggaggaggagcggatgcccattttgtcgtagtggtcgccgaagtagaagcccttccagcccttctccacgatgaaggcgctgatgccccgggtgccgatatccggtgtggtgacggcaaagaccacataggtgtccgccttgggggcgttggtgatgaagattttgccgccgttgaggacatagtggtcgcccttcaggacggcggtggtctcagtgccgccggcgtcggatccggcgttgggctccgtcaggccgaaggcgccgatcttctcgcccttggccaggggcaccaggtacttgcgcttctgctcctcggtgccgtaggcgaagatgggccaggagcctaaggagacatgggcagacaggatgacgcccgcgccgccgtccacccgggccagctcctccacggcgatggcgtagctcagggcatccagcccggcgccgccgtactccgcggggaaggggatgcccatgaggcccatctcgcccagcttccggatggcctcgtccgggaactcgttctgctggtccagcatgaacgcgatgggtttgatctcctcctccgcaaacgcacggactttagcgcggagttcctcgtgtgcctgtgtggtctgaaacagcatagtcgtacctcctctttaatcttgataaaatttatcaactttcaagcaaaagaaaaactgtcaaatcaggggtccgtcaaaatctcctgcaggctgtgggcccgcagctcctcgtccagcttgttctgaatctcagccagcttgcagtgcacggtgcagccgccgtggcagctgcgccaggggcattgatacgccggatccatgcaggagctcagattcccgcgttctcccatggccttcatcaggtcatagaggctggtgccggtcaaatccgccgacagccgacagccgcccgccgttccgcggaccacctccaccagtccggccttctccagctttttcaggattttataggcaaaggcctgggggaggagttcatcctgtgcgatctgtcccgcggtatgcagttttccatccaacagtgcccgcaggatgcgcagggcgtaatctgtctcccgggtaatgaccaatgccgcgttctccttttatacgtcgtattgttaattggagaataccaatttggatattttttgtcaagtatcggatgcaaccctataaaaagtttggcagtgttccataaaaaaccagtcgtgattttgataaaatgccggggcggacgccctgggactcacggtgggcccacccgccgggggacagccggatatcggtgtcgttgccggggaacacactgttctgaaagtccggcgcggggtctgagggaaccgatttcagcaggacggcgatgccgttgtattcaaacgtattttcgttgtatagggagtggccgggagtgccatcggtgcagttgaaacggaaccgattgcccgtaaaggtgcagccggatgtgtgctccaggcggagatcgaaaaggcggtgtcccagacggtgaaggtgcagctgctgaccggctctacgacggcgaggtcttccgctgtgagctgtggctgccgtccgcctcttgacagcggcgggcgatctgctataattctgataaagttcgcaccatgcctgctgacaggggtgatagctgcagcccctttcgggcgccggccgcgagtcgcggccggttggctggattctggcgtatgcgcttcgcgcaggcgagcccgcttgcggtattggagcacacctgcgatgtgctggaagataccgccgcgcggttccccatacaaatttgtatcgctccgtaggcatgagaagggaggagagcacttgattgtctatcgggagctctcctcccttgtgcgggatctggggatccccgccgggacgctgtatgccgtcagcaatacactggaccgccattacatccgcaggcagctccccaagtcctccggcggtgtgcgggagctgtcggtcccggacccgctgctgaagcacatccagcgccagatcctgcgggtgctgctggtccacatgcctgtgtccccctacgccacggcctatcgatacggcggcagcaccctgtgcaatgctgcgccccatgtgggaaagccctgtgttttgaagctggacatctgtcatttttttgacagtatcctgtattccgctgtgaaggaaactgcctttccagctgaggtttatgcagagaacttacgtattctgctggctatgctgtgctacgggtgggatcggctgccccagggggcgcccacatccccctgcatcaccaatatccttatgcgggactttgacaacgaggtgggggcctggtgccgggagaggcagatcgcttacacccggtactgcgacgacatgacgttctccggcgatttcgcccgggatgaggtgctccggtgcgtggagccccggctgcgggcgctggggttctatctcaatcccggaaagacaaaatggctcccggcagaccgccggcagcttgtgacaggtattgtggtcaacaaaaagtgcaatgtcccgtccgaagagcgccgtgcactgcgccaggagctgcatttctgccaaaaatttggcatctccggccacatggcgcgagccgggatcgacggaccggaggaccgctacctggctcagctcctgggccgggtcaactaccagctgcagatcacgccgggaaggcgggagctgcaggaagcccgggactggctgatcaaagcacagccgcaatacggcggagggcgggagacatctccggcagaaaaacagatattgtgacatggaaaaagcgggaacatcacgtagatgttcccgctttttcggctttttccgaagagctcgggagaatatccccggcacataaaccgccgtctgtaaggtaaaataaggaggatcttttgttgaggaggtctgcaaatgtctgaacttacgatttccagtgaacgactcacagcctttgctgcgcacctgcgtgccgaggagcgcagcgccggtaccatcgagaattacctgcgccacatccgggcattcgccgtctggctggacggctctccggtgacaaaggagacggcggcagcctggaaagagcatctgcttacgcaggactatgcgccggcaacggtcaatgccatgctggcggcgctcaacggcctgtttcactttctgggctgggacgggtgccgggtaaaatttctgagagtccagcgccggctgttccgggacgcgggccgggagctgacacgtccggagtacgaacgtctgatggagacggcccgttccagaggacaggagcggctggcgctgcttatggagacgatctgcgctaccggcatccgtgtctccgaagtgcagtatatcaccatggaggcagcaaaacggggccggacggatatctttttaaaagggaaaatccgaaccatcctcctgccggaaaaactttgccggaagctgctgaaatacgcgcaaaaacacaaaaccgcttctggtgagatctttctcaccagaagcggaagaagcttgagccgccgtcagatctgggcggagatgaaacagctgtgcagatacgcaggagtggagccgggaaaagtattcccgcacaattttcggcacctctttgccacgatcttctaccgggcctgtaaggatattgttcgattggccgatgtgctaggccacagttccatcgaaaccacacgcatttatctgacgacctccggtgcggagcacgcacagcaactaaacaggctgggattgattttataggacataatttatattttgaccatataaaagcgaaaataaatatctttacttactgtatagatagtaatattataccatctggcattttgaaacacaagacccatcccgtcttttgacacacaaaaagagccgcaaaaatgagaaagattgcggcttttcttttcatacccatcagtgcctggaaggcgctgctggcgtggcactttttctttctcacagtgcaaactgtgcagagccagatattttatatagtcaaaatataaattttgaaataaaaatattctaaagagaaaaggatcgaacagacgctgacccgtgacacccggacagcgcgctagacagatacggtgtccaagaaaactcagtaatccacagcggacgaatctgcggtctgctttcgtctgctgctggagcatttccaggagcggtctctaaatgaaccgcttatcgtcagttgggaggaggtgatgggacatgctctgtgattttcctgttcgcagtgtttacaggcggtctccggagcgggagccgcctgtaaagcggctgtatcattgtgcgttctgaacctgaagcgcaggggttataaagaagttataaaaggaggaaacgagaaaatgaagagaaagttgctgtctgtcctgatggcgctctgtctaatactgacgttgcttcctacggcagtgtttgcagaggaactcacacctccggaagaatccggagaacagcaggaagagcagatcaaggagccttcgactcctgaaaaggagccagacgatccggagaaagagcaggagggagaagaggaccttcagcccagtgacggggatccggaactgcccgccggtgacggagaggatgaaagggatccgcagacgccggaagacggtgtacaggaccccaccggggaggaaatccctgaaaatggcagcacctctgtgccgaatgaggtgccgcttcaggagatcattcttctggaggagtccgccgttaccatggaacagaacggcgggacgacggaatatgactccgtcagtgcggccatcgacgctacgcaagcgtataacaaagacaccaacaaagggctgtacaccattacactgaatgagaacttggctgaagacgtggtgatcccggaaggccggtatatcaaaatcgacctgaacggccacaccctgaccaataaggaaagtcatacgatcttcaacaaaagcacccggattaccattgtggatacctccgcggagaagaccggcgtggtggataacatcagccatggcaggggtgcggtgtacaacaacatcaatgcggccatcaccctgcagggcggctcttatacccgctctcaggaggccagtaccggcagcgacgcaagcggcagcaacagctggtatgtgttgaagaacttcggcaccatgaccatcaaagacggcgtcacggtgaagttttctgatagcaactccggcctctattccagcctgatcggcaatggctggcagaacagctccgcagcggaggctggatccaatggtgagccccagcccagcgcgggcgggaagcaagccaagctgaccatcaatggcggcacctttaccggcggccagatcacagtaaagaatgacgattacggagagctgaccattaccggcggcaacttcacgcagcccggcgagaatcgctatgccgtatataatgccaacacggcaacgatctccggcggcacatttaccgccgagagcacggttgtgggctctgactactttgcaggcgaggccaacaccggcaagctgaccatttcgaaaggaacattcaccagtgagagcagcggaaccgccatttccatgggggccggcgcggatctcacgctcaccggcggcaccttccagacgcagggcgacggctcttcgtacgtgatcagtctggcagaaacggccacagcagaaatttccggcggcagcttccccggcgccgaggcggcgcgggttgtcaacagttccgacgccttcagggatggttacggcgtggtggaaaatccggatggctccctctctgtcggggtgaaagacgagtccgccgaggcggtcgtgattgcccgggatggaagcagaaccaactacctgactttgagtgcggctgcgaaagcagcgcctgccggcagcaccgtccagctgcagaagaatctcgtgctcacctccggcatcagcactgtaaattatggcgtgaccattgatctcaatggctatgatattgacggcacggcagttaccagcagtgacggcgcagtggcattgaagacgaattacagcagtaagccggttgacggcgtggactccactatgcggctcatcaactcggtttccgggcagggcggcaccattcaggcgaagctgcctgtcagcgtgaaatccgggaacagtacgattccgctgcccgccgaaatcggcgccggcgtgacacttgtggttctggagggcggtacggatgctgtcaagctggacagcagcgcgtatctcctatacagtgaaactgcggcagactatattgccaacggcggcttccgggtgagcgtcggcggtgtcgaccgcatttatggccgctatgccaatgcggcgagtgctgccggggacaatgccgtcgtgacgcttctgcacgattatactggaagtgacaagatctattccggcagccgcagcggcacgctgaatcttgccggcagaacgtatacttacacaggctcagacgcgattgtagatgtcaattatgagaatgtcggcctcaccatccagaacggcaccctgatggggacaagccctgaggcagatggagctcaagtgctgtacagcaacagttccctcaccctggaaggtgttaccgtcgacgttaagggagaagatatctacggcatcgtcaccaacggcaccaatgtgaagaacgccatcgccctgaagaacagcaccctcaacgtgcccaatgggaacggcatctacttccccagcaccgggacagtgaccatcgaaaactccatcatcaacgccaagtatgtgggtgtgcagatgtgcgccggcagtctggcagtacggggagcgcagacggccatcacagtgacaggggagccgacgcaaaaaactgacagcgacggcgtcatcggcgacggcgctgccatctccattgtggagcgggagggctatcaggacctgggcaccgtcaccattgaggacggaaccttccaatccgcagaaagtgttgatgcagtcaaggcctacgccttcaataatgcggataagacggaagaagcatggcccactgccggcgaggtagtttccgtctccggcggcaccttctccgctgaagtgccggaggccttgtgccaggacggctatgtggcggtcaaggatgagaacggcagctttgtggtggggaaagatcccgccaagacctttgtggcgcagataggcgacagggagttcaccacgatccagggagccattgacgcggccgtctccggcgacacggttcagatcaaacccgggacctatgccgaggatctcacaatcagcaagaagatcacgctgcttggcagcggcgcgggcgaagccggcacgatcctgacgggaacggtcagtgttgccgcggatggcgtcacactggatggcatctggttccagcagacctattctgaggaggactctaaggaccagggtgcctgcaaattaaaaaccacggaaacgggaacaaatcttaccatccaaaactgcattgttcagcggatgaccggcactgcaattccctatggcgccattgttcattacggcgccgccgaaggaaccctgactctgaaaaacacggaattgatcgcccctgttgccgggaccgcagacgaaatcaacagtgcgtctccttctgtgatcggcgttgctgcttgggcgcaaaccggcgagaatatcgacgaagcgtggaagctggttgtaacagactgtaccatccgtaccaacggatttgcggtgtttgaccgttggaacaacgccacctataccaatacgaccttcaccggactggaaggcgtggagggactcgatgacatcgaggtcaaaacgtgctatatggcgctcaataatccccatgcaaatgatgtgacatacgatcattgcaccttccggaacatgcgcagctggggaatgctggttgcaggcgaagagctcacggtgacagactgcacctttgatggaacaaaccagtcctgtgcgatctctgtggcctatggtacaatcgacaagtgtacgattacggggaacacctttgatctgagcggcagcggcagcggaattatgttcagcggcgcggtgaccgaaacctccacaatcacagttgcggacaacacattcaaaaactgcagccaggagggcggatactgcgtcaataataccagcgctgtggaaggagagcaggttgctccgatcacggtcacaggatccacctttatcgactgtgcgaacaagtatctgaaccaggtaaatgtggaggaagccgcagcctctgataccgcttacgtggtgtccggaaacacggagacgtactacgagacgctggcagaggcgatctcctccgcgcccgtgggttcggccgtgtatctgctgaaggacatcagtgaaacggtctccgtctccaagaacatctctatttacacaaacggccatgctttcagtgcggcaaatatccaatgtgccgcaaactactatgtgcggcagatctcgggagggtatgaggtttattattctgccccatctaccggctccggcggctctgacagcgatcccagttacgcccccatcctggatgtcggcagcggcggcagcgtgaaggtgaatccccggactcccgaggagggcgacaaggtgaccatcaccccggatcccgacagcggttatggggtggacgaggtcatcgtcaccgaccggaatggccgggagatcgacgtcaccgccaatcgggacggcacctatacctttgaacagccccgcggccgggtgaccatcgaagtcaccttcacccgcaccggagagagcgccttctttaccgatgtgccggagaccttctgggcctacgatgagatcgcctgggcctatgacaacggctacgtcaacggcaccacggccacgacgttcagccccaacggcagcatcacccgccagcaggtgtggatgatcctggcgcggctcagcggacagtctcccgccaacatggcagaggcgcgcacctgggccatggacaacggcatctccgacggcaccaaccccggtgcggcggtgacccggcagcagctggtggccctgctgtaccgctttgcggaactgcggaattatgccaacggccagcgggccgatctgagcgcctatccggatgccggcagcgtggcggggtacgcagtggaacccctgcagtggtccgtggccaacggcatcgtgggcggcaccagcgcagggacgctgaaccccgctggaacagccacccgcgcccagttcgcggtgatcctttatcgcttctggaatcaggtggcctgagacaaatcagaataagacagcagggcggagaaatccgccctgctgctttttgaaaaagagaaccaccggcaaaaccgatggttccaaaaagctttagccatgccgaaaaaatatcctcctttggtagaacaatggaggtctgccaactgctacaagaaccaaaggaggaaattgtgtgagtacaaggggacagaaattatagaggagaggcgtacaaagatcatgttcacatattggaaggtatcccgcccaagtacagcgtttcacagattatggggtgttgaaaggggaaaaatagtctgatgatctatgaaagcatgcgaacatgagataaatatggaaaccggcatttctggcgtaggggatatgacggcgcgaaggcggaccacatcttcaacggaacaggggatcaagaatcgtactgatggagaaggggcgcacctatatatcggataccggatatagattgctgttcaaaagggagcaatgcggatactatctccctatatacagatggttccaaaaccagccggaactgctgcccatattccgccggagagggatgagaggcagggcctgaaccatgcggcaagaccggatcggccgattgccttttccggaaggactctgtgcatcttctgcggccggggcaacagactagggattgggggaaagatcatgcttgttatgcaaactccatctgcgtctcagacaggaaacacagatggagctgtttcattcggcggcactattttttcagattccccgttgccgggttgtcgatcaacctgccctcctctgtaaaacgggagccgtggcaggggcaatcccacgtgtgctcctgcgggttccatttcaacgcgcagccgagatggggacaacgcttggcggaaggggtcaggaggttgaccacggcctcgaagccattgaccaccaattgggggcgaagaatcgttctggagggggaaaacacctcggcataggggctctgcttcccttggacaagatcgcacaggaccatggccgataccatggcggaggtcattccccacttgttgaaaccggtggccacatacaggtcggatgcgctggcggaataggggccgatatagggaacgccgtccagagacatgcagtcctgggtagcccagtgggatgtctccgcggccttgggatagtgccgctgggcgaaatcccgcagttcctgccaggccccgccctgttttccggtgcggtggtctccgccacctaccagcagcaaattcttgtagttgcgaaaggacatgcccgtctgggcctcgtccacatacatgccgtctacattcggggcgttttccagggcaatcacataggagcggtgctgatacagtttggcaaagaagctgccgtgcttattcaaaaagggaaagtgggtggctacaattattttgtttgccgtgacttttccataatccgtaattgcagttgttccgaccagctcccgcaccggcgtgtgctcgcagatgtgcaggctctttgaaatcgcggcgatccatttcagcggatgaaactgggcctggtttggatatcgaactgctccggccacagggaaggggagggggaggcggtctgtaaattccccaggaacccccagtttttccagggcatccagctcccgttcgattttccggcggtcattcagagagtacacataggcggtcttttcttcaaagtcgcagtccatgccgcggcacagctcccggtacttctgaagggccgcttcattggcatcaaggtactgtttggcctggccagctccaaatttacggatcagcttgtcatagatcaggccgtgctgggaggtgattttggcggtggtgtttttggtgatcccgccgccgatcgtctcagcttccaagagcagatagaggactccggcctggtgcagcagatatgcacataaaacccccgctatcccccgccgataatcaatacatcggtctttgcatcctgctccagatgacaaaaccctgtatgtccggacgtctgttcccacaatgactccatatacgatcctccaaatgcgtaatttagaaatagtgttctccaaatcacgggaacaatatgtggaggttcgacacgatggctctggatggaagggcgagccaacggctccgatgtacacgctcaccctgtaccgacggaaagactccgcagattgaaagccgtcatttgcgcttccgccatccggaaattccagatgcaaggaacagcactcagccccaggcagacacagatctggacggcgcatgggagatgcttttgaaaaatccggccaaaacgcagcgcagcggcgcaaaggcggcgttgtcctggagcctcataaaaattccttcccgaaaaatagtcttgtgtttgtgctgccggtcagctttgctgtgcttcctgctgcttgcggatatgaaagcggaggcagtccagacgctccagctgcggcctgatatactgaatcgaaagatggaaagctgtcccgacacaatccgcctccgcagctgtcaattctttgataactctggccggaagcccgggcaattcctctctggagatacagtggctctataaagagctgctgaaaaaggaggacgttcaaagcaaagagaaccgctgtaaagcaaaaagacttgtatgcaaaacagtgcggaatcttcgccaaatgccgtcccccgccatggaagtagaggcggaacagtcgctcatccgaacaaccccggccaagagctgcgcacactgcgaaaggtggagcgcaggaggtgaaggacctgacaccggatcagctgacagcgttttttcagaaggccgggaaaagcggcgtgtatgaacgctgctacatggacctggacaaccggcctgcggcggggagagctgttgggattaaaatggacaggcattgacttccagagaaaaacgctccgtatccagcggcgtatcgcccggcagaacgggggaaacgtgaaaacagtctctggaatgatgggccattacagcgccggattcacgctggacacctacgcccacgtcaccaaagacacccagatccaggcggtaaacacggtcagcggcatcctgacagcagcgaggaactgatagtaatggtagaagtagcctgaaatttcaccggcctgtggcgtgatatgggcagagacgaagcgggggaaggaccggagaaaaacagagaagcctgtgttcttagagaacacaggcttcttgctggtacgccctgagggattcgaacccccggccttctggtccgtagccagacgctctatccagctgagctaagggcgcacatcctgtcctgccggacagctttattataatagcatgtctgatttcaaaatgcaagagtttttttggattttttatgttaattttcaaacccttgtaaacgccggggttctgtgctaaagtggagttaaagttttcattcgggaaagagagaagcggaccatggagaactacgcattcaaaagcgtcgcgttcggcggattcgacaagcaggatgtgatccactatattgagcagactgccaaggaggccgccgccgtccaggagaggctgcagaaggagaacgaggacctgcagacagaggcggacagcctgcggacccaggtccgggagctgcagacgcggctggagacggagaccgccctccgggagcaggcccagtccgagctggagcaggagcgcacagcccggcaggggctggaggcattcaagccggaggctgaacggctggccgctgagctggagcggctccggccggaggcggaggcctacgcccagttccgggaccgggtgggggacatcgagtgcgacgcccacaaacgggccgctgagctggaggcgtccaccaccgccaggctgcgccgcacggtggagctgttccgggcccagtatgtgacgctgatgtcctccttcgagtccaccgcctcccatgtgacggcggagctgcggaaagttgaggtcaacctgtctcagctgccccgggcgatggaccaggcggggacagaactgaacgagctggccgccctgctggaccggagcactaagaaagaggaaaaagagccgcggggttgagcaccgccggatctgaacgctcgaatggtgagccggtcgaaaaacatgcattggtcaaagccggattgagcccgcagatcgaccgcaaagacttgggcgcactccgcggataattgcccccgaagctgcctaagataagacgaacggggagactgccctggaaaggaacgacgcgctatagacgaccatccgggtattcctgccgccggcaagcggcggcagggaggccctgaagccatccatttcgcatagagaagccccatgacaggaaagaggtgaagaagatgccactggaagtcatcgagaacatcacacgcgtggaggcggataaccgggagcgcaaggcctccgcagaagcaaaggcgaaacagatcgtcgccgatgcacagcgggacggtcttgcgctcttgcagcagacgcgggctgccgctgcggaccgggggcgggagctgctccgtcaggcggaggcaagagctgcggccagaggagacgagatcgggcaagaagcccaggcggaggcggagcgcctgcgccgtgaggcggagaagcggctggacatggctgccgatctcattgtcggaagggttgtgaaagactgacatggccattgtaaagatgaagaggctccgggtgatcgccatggcagcctgccgggaagagctgctggggcagctccagcggctgggctgtgtggagatccgggagccggagaccgccggggaggactggtccggcctgctggagcgggagagctcccgcctggcggaggccaaaggcgccctggcggaggtgaacaccgccctggccgccatgcggcggtacggacaggtgaaggacgggctgtttgtcaagcgcaggctcgtcacagagaaggagtttctgggcggtggactggaggcgcaggccaaaaccgtcacccaagacgtggggagcggctgcggaccctttccgggatccagaccgagatgtcccgccttcaggctcgccgggcagggctgctgccctggcaggatctggacctgccgctggaggcggagggaacggagcacgtgctctcccgcctggggacctgccccgcgggaacggacgtgggcgccctgcggctagagttggaggcgctgcctgcggagctgctggagatcagcgccgacaagcagcagcgatacctgctgctcctctgccaccgggcggcggaggagccggtaatggaggtcctgcgggcccacggcttcagcgcggctgcttttccgggggtcaccggcacggcggcagcggatctgaagcagaccgaccggcagctggaggagctccagcgcaggcgggaggaggccgaggcggccattgcggagagcgcccgggagcgggacaccctgcggacctacgcggaccggctgacagcggagaccgctcgggagagcgcggcggagcggctgcttaccgacgggaccattgtcttcttcgagggatgggccccggcggagcgcatggcggacgtgagcgccctgctggagcgcctgggctgtgcctgggaggcggcggatcccgcgccggaggagtatccggaggtgccggtgaagctgaagaacaactgtctgacccggccgctgaacatggtgacggagatgtactccctgcctgcctatgacaatgtggaccccaaccccctcatggcgccgtttttcatcctcttctacggcgtgatgatggcggatatgggatacggactgctgatgatgctggcctccgtctttgtcctgcggacataccgcccgaagggaacgatgcagcacttcttcggcctgctgggcctgtgcggcatcagcacctttgtgatgggcgccctgacaggcggtttcttcggcgatttcctcacccagctggcccagctgatccacccggagagcacgttcgccctgccagccctgttcacgccgctggacgacacgctgatgattctggtgggcgccatgtgcctgggctttgtccagatcctcaccggcatggtgatcagcgtggtagggaaactgaagcgcggacagttcctggacgcgttctgggaggagatcacctggtgggtggtcttcgccggaatcgcgctggcagtgctgggggtgacgaacctggtgctgtatgcgggcatcgtgctggtggtggccgggcctgtcatcaacggaaagggattcgggaagatcaccgggatcttcggctccctgtacaaccacgtgaccggctatttcggggacatcctgtcctactcccggctgatggccctgatgctgtccggcagcgtcatcgctcaggtgttcaacaccttgggcgccatccccggcaacgtggtggtgttcttcatcgtctccatggcgggaaacgccctgaacttcgcgctgaatctgctgggctgctacgtccatgacctgcggctccagtgcctggagttctttaaaaacttctatcaggacggcggaaagcccttccgccccctggcggtggatacaaaatacgtggatattcaaaaagactgaggaggaatcgagatatggagttctttgaggcattcggcggtttggcattgggtctgctgggcgctggtctggcagcggtcctctcgggcatcgggtcggccaaaggcaccggcatcgcaggcgaggcgggcacggggcttctgtgccaggatcccagcaagttcggcaaggtgatgatcctccaggtgatccccggcacccagggtctgtacggcctggtggtgtggtttttcgcggtgttccgcatggggctgctggacggcaccgcctttgatatgaccgtgcaggaggggctgcggtatttcgtggcctgcctgcccatggcgttgggcggcctgttctctgccatcgcccagggccgcgtggccgccgggtccatcaacctgctggccaagaagcccgacgactggtccaagggcatggtgctgtgcatcacggtggagttctacgcgatcctgtccctgctggcctccatgctcatgattatcaacatcagcggctgaccctggagaaaggggacagagtatgaacggtatcgacaagatcacacagcggatcggcgcggacacccaggcggagatcgaccgcatcctggcggacgccgccgcccaggcggaggccgcggccgacaagttccgcacccaggcggaggccgaggaccgggacctgctggcaaagagcgagaggaccgcggcggagcgggaggagcgccttgtcagcgccgcccagatggaggcccggaagacgcttctgaccgccaagcaggagatggtggaacgggcttaccagcgggcgctggaaaagctccgttccctgccgcaggaacagtatgtggagctgctggcggcgctgctggtgcgggcgtcctccaccggacgggaggaggttgtcttctccacggaggatcgggagggcgccggcaaggcggctgtggcccgggccaacgagctgctggccaaggaggccgcgccggagctgcccctcggggacggcgtggtagccaatcttctgaacaaggtggccgccggcgtcagcgccttcgcgcagggcacggccatgctggccgtgtcggaggagacccgcgacatctcgggcggcttcatcctgaaggatgggcgcatcgaggtcaactgcacctttgacgccctggtgcgcgcggagcgggagcagaccgccggcgaggtggcgaagctgctgttcccggaggcgtgaggaaggaggcgtcggtttggcaaagaccatcaaggacaccgattacctggtgatctccgcccgggtgaaggccctggagacagggcttctgacggcggagcggatggagcagatcctggatgccaaaagcggcgaggacgcggggaagctcttgcaggagtgggggtatccccagctggatccccggcggccggaggccatggacgcggcattgtccgccgtgcgggaggccaccttggccgacttggcggagggaacgccggacgcccggtatatcgatctcttcaaagtgaaatacgactatcataatgtgaaggccctgctgaaggcggaggctgtgggcaccgccccggaccgtatgctgatggacatgggccgggtaagcaccgccgaactggcagaggcggtccgatcccgggagctggatggcttgccggagacgctggccgcggccgtggtggaggcccgggaggtgctggacaccacccgagatccccagctcagcgacatcgtgctggaccggtggtgctaccgggatatggcggccctggcagaggagaccggcagcgcgttcctccggggctatgtggcggtgcaggttgacgcagtgaacctgcggacggcggtgcggacgctgcgcatgggaaagggggcggacttcctcctgggcgcgctgctggaggggggagacctcgctccggatgcggtggcaaaggccgcctccagcggggccgcgggcctgcgggagctctacggcgccacccgtttccgcgacgccgcggaggcaggggcagaggccctgaagggcggccccctgacggcgtttgaaaagctctgtgacgacgcggtgggggactatctggcgggcgctcagtccgtgcctttcggcgaggcccctctggtaagctatctggccgcacgggagacggagtacacgaacctgcggatcctgctgatgggccgcgccgccggcatcgacccggcggtgatccgcacccgcctgcgggcaagctatgtgtaaggaggcggcgccatggccacaacgtatcggatcgccgtgatcggcagctgggagtccgtcatgggctttcgggccctgggactggagacgtatcccgtcaccgcccccgaggaggcccgggagaccatccgggagctggcaaagagcggcgactgcggcatcatctatctgacggagcagctggcaaaggacctgccggacgtgctggaccggtataaggacgagctgcggcccgccatcatcctgatccccggccgggagggctctctcggcatcggtatgaacaacatccagcagtccattcagagagcggtgggcgcggatatcctctgaggagaacaggctgacgccgctatggcattgcgattttcgaccctgtttgggccgcaatcgcgcctcgtgtgcacaccgtcgggccaagccggtcagcaggtgttgccgcacctgccgaccgggggccttcctcgaaacagccccgcttttccgcctctggcggcgtttcggctgttttccctgagatgtgccggcgggcgaacccgcctgcgctgaattcccgcgccggtctgcacccaaggggatttccgcgccgcttccagcggcttgggcgcggactggtggacgccgccccaggcggctgagtcggggattgttcaccgcatacacgctgcggcggacatgatgaatatttttcttttgccttacggtgggagaactggaaaaaccgcgggtttttccgggcactatttcttggctccggcggttcgcgccggaggtccttccggcgaaactggtgtgaaagaaggttgagcgagtttgagcggtaagattgtgaaggtatccggaccgctggtggtggccacgggcctggcggacgccaatatgtccgacgtggtccgcgtcggcccccagcggctgatcggcgagattttgacgatgaagggggactccgcctccatccaggtgtacgaggagacctccggcctgggaccgggggcggaggtggtcaccaccggcgctcccatgagcgtggagctgggccccggcatgatcgagggcatctatgacggtatccagcggccgctggagaagatcgtggagaaggtgggtgccaacatcacccggggcgtggaggtccccgccctggaccgggagaagaagtgggacttcaccgccgtggtcacccccggcacaaaggtggagggcggcgacgtgattggcaccgtgccggagacgccggtggtgctccacaagatcatggtgcctcccaacatgagcggcaccattacggacatcaggagcggctccttcaccgtggaggagaccgtggccaccctgcgcactgacaagggggaggacgtgcccctgaccatggtgcagaagtggccggtccggatcgggcggccctacaagcacaaatatccccccaagcggccgctgtgctccggccagcgggtcattgacaccctgttccccattgccaagggcggcaccgccgccgtgcccgggcccttcggctccggcaagactgtggtgcagcaccagctggccaagtgggcggatgtggacatcgtggtctacatcggctgcggcgagcggggcaacgagatgaccgacgtgctccgggagttcccggagctgaaggacccccgcaccggggagtccctgatgaagcggacggtgctgatcgccaacacctccgacatgcccgtggccgcccgtgaggcgtcggtctacacgggcatcaccatcgcggagtacttccgggacatgggctacgacgtggcggtcatcgctgactccacctcccgctgggcggaggccctgcgcgagatgtccggccggctggaggagatgcccggcgaggaggggtaccccgcgtaccttgcctcccgcctggcccagttctacgagcgggccggcagcgtggcctgcatcggctccgatgaccgccggggcagcctcaccgccgtgggcgccgtgtcgccgccgggcggcgacctgtccgagcccgtggcgcaggccaccatgcggattgtcaaggtcttctgggccctggattcgtccctggcctacaagcgccatttcccggccatcaactggctgaactcctactccctgtatctggactccctgaagccttggtttgacgagaacctgggaccggagttcctggaggaccgggccagcgccatgagcatcctccagagtgaggccagcctgaacgagatcgtccagctggtgggcaaggacgccctgtccccggcggaccagctgacgctggaggtggcgcggatggtgcgggaggacttcctgcagcagaacgcctttgcggatgtggacagcttctccagctacgaccggcaggaaaagctgctggccatggtcctgcggtacgaccggctgtgccgggaggccatctccaagggcgcgccggtggcgaagctcttcgccgttccgtcccgtgagaagatcggccgggccaagagcgtgccggctgaggagtaccagcaggtctaccagcagatctccgcggagatggagcaggagatcaccgccattgcggaggaaggaggagaggacgcatgatccgggaatacagaacggtagaggagatcgctagtcctctgatgatcgtccgcatggtggacggcgtcacctatgacgagctggtggaggtggagctccacgacggctccgtccgccggggccaggtgctggaggtcaacggcgacaccgcggtggtgcagctgttcgagtccgccgccggcatcaatctggcggacgccaaggtccgcttcctgggccatccgctgcagctgggcgtgtccgccgatatgctgggacgggtgttcaacggcatgggccggcccatcgacggcgggccggagatcctggcggaggagtaccgggacatcaacggcctgcccatgaacccggcggcccgggactaccccaacgagttcatccagaccggcgtcagcaccatcgacgggctgaacaccctggtccgcgggcagaagctgcccatcttctccggctccggtctgccccacgccaatctggcggcccagatcgcccggcaggccaaggtgatcggagacgacacctccaagtttgccgtggtgttcgccgccatcggcatcacctttgaggagtcggagttcttcgtcagcgagttcaagcgcaccggcgccatcgaccggacggtcatgttttcgaacctggccaacgacccggcggtggagcgcatcgccaccccccggatggccctgaccgccgcggagtatctggcctttgagaaggatatgcacgtgctggtcatcatgactgacatcaccaactacgccgaggcattgcgggaggtctccgccgccaagaaggaggtccccggccgccgcggcttccccgggtatctgtacacgaacctggccaccatctacgagcgggccggccgccagctggggaagaagggctccatcacgctgatccccattctgaccatgccggaggatgacaagacccacccgatccccgacctgacgggttatatcaccgaggggcagatcatcctcagccgggagctgtaccgcaagggcatccacccgccggtggacgtgttgccgtctctgagccgtctgaaggacaagggcatcggcgagggcaagacccgggaagaccactccggcaccatgaaccagctgttcgcggcctactccaccggcaaggacaacaaggaattgatgtccattctgggcgaggcggctctgacgcccacggacctgctgtacgccaaattcgccgacgagtttgagaagcggtatgtgaaccagggctacgaggagaaccgttccatccaggagacgctggatctgggctgggagctgctgagtatcctgcccaagagcgagctgaagcggatcaagccggagtatatcgaaaagtactggcccaagaaggagctgtgagccccttccggggaccccgggattttggcggccgccctctcttggctgcggcccatgatgaggatttgccgcgcgtctgctgcggcgcggaggcgccgggccgctgaccgcgggcccccaggccaggatggaaagaaggcgattgacagatgcccaatatcacggtcaaccccacccggatggagctcacccgcctcaagggcaagctccgcactgcccagcggggccacaagctgctgaaagacaagcgcgacgagctgatgaagcagtttctggacacggtgcgggaggtccgcgctctgcggcaggaggtggaggaggagctgatgacagtccacggcgccttcaccgtggcctccgcgctcatgagttcccaggcgctggaacaggcgctgctggaccccaagcagagtgtgaagctgacgcagaccaccaaaaatatcatgtcggttaacgtgccggtgtatgatttccagacgcagacccggtctgacgcggacatctacccttacgggttcgcggccacctccggcgagctggacacggccgtggacgccctgggaaaggtgttccggaagatgctgaagctggcggaagtggagaaatccgcccagttgatggcggaggagatcgaaaagacccgccgccgggtgaacgctctggagtacgtggtgatcccaaacacccaggacgccatccggtatatcaccatgaagctggacgagaacgaccgggccaccaccacccgtttgatgaaggtgaaggatatgctgctgcagcagtccatcgaggaacagcggcagcgggacgcggaagtgctggagcggttccgggaggcttgacgaaatacgcaaagcggtgtaggataataacgctacaccgctttgctgcgtttaacgcgttagaaaggaagaaaagcaactatgcattgcgtgacaaacatccacgaggacctgtactggctgggaggctctgaccggcagctggcgaagtttgagaatgtgtttcccattccccggggcgtcagctataacgcctatctggtgctggatgagaagaccgtcctgctggacacggtggacaaggccgtgggggagcggttcttcgagaacctggagtttgccctggccggccggcccctggactatgtggtggtgaatcacatggagccggaccactgcgccaccctgggcgagctgctgcgccgctggccgggcgcccaggtggtggccaacgccaagactgtccccatggtcagccagttttttgactgtgatatctccaaccgggctgtggtggtgaaggagggggataccctctgcaccggccgccacaccttcaccttcctgatggcccccatggtccactggccggaggtgatggtgacctatgacgccgccgacaaggtgctgttctccgccgacgccttcggcaccttcggcgccctgaacggcaacatctttgccgatcaggtggactttgagcgggattggctggacgatgcccgccgctactacaccaacatcgtgggcaagtacggtgcccaggtccagtccctgctgaagcgggccgccgggatggagatccagatgatctgtcccctccacggtcccatctggcgggagaatctggagtggttcctggagaaataccagcgctggagcacctacacccccgaagatcggggcgtggccatcttctgcggctccatctacggccacacggagaacgccgcggagatcctggccgcccgcctggcagagaggggcgtaaagaacatcgccctgtacgacgtgtcccatacggacgtgtcctaccttgtcagcgaggccttccggtgcagccatctggtgctggcttccgctacatataacggggagatctacacccctatggagaacttcctgcgggatctggcctgccacggtctccggggccgttccgtggccctgatcgagaacggcacctgggccgcccgctccgggatgctgatgaccaagctcctggaggagatgaaagagatgcgggtgatggaggggaccgtgacgctgaagtcctctgtcaaggaggcccagcgccgggggctggagtccttggcggacgccattgccgacgagctgctccactgagaggatgagaaaatacccctgccggagttccggtgggggcattttccgtttcaaaggcccgaaaggggcggaaaaagccgcccgccgtgatctgcggcgggcggcttttctgtatggtaactttactttacaacagcgtgataccagcatcttcacatgttttcgtggtgtcagcatcccacaggctcacctgaacctcgccaatgtggcaggtgccgatcagcagcatgcacagccgggactggccaatgccgccgccgatggactggggcagctggccgttcagcagcatcttgtggaagggcagctcccggcgctggttgcagttcgcggcggtcagctggcggtccagagccgcggcgtccacccggatgcccatggaggacagttcgaagctccgctccagaatggggttccacatgaggatatcgccgttcagctcccaatcgtcgtagtcgggagcgcggccgtcatggcgcttgccggaggccagggtcttgccgatctgcatcagaaacacggtgtgatgcttgcggcagatctccacctcccgctcgttgggcgtcaggtcgggatagcggtcctccagctcctgggtggtgatgaagtacacgtcccggtccggcttgaaggtcagggcagggaaggcgttgcgcagggcagcggaggtgtcgcagatggcgcccacgatgtcgcgcaccgtctccttcaggtacagcacgttccggtctttgggagagatatgcttctcccagtcccactggtccacatagatggagtggaggttgtccacctcctcgtcccgccggatggcgttcatgttggtgtagaggcccgttccctcggggaactcgtaccgcttcagggccaggcgcttccatttggccagggagtggaccacctggccgtcggtgcccacatcggggatgtcaaaggagacagggcgctccacgccgttcaggtcatcgttcaggccggtgcggccgtccacgaacaggggggcggagacccggtgcaggttcaggcgcacacaaaggctgtgctgaaactcctggtggatcagctcgatggcccgctggagctcgttgttgctgaggggcatccggtagccggaggggatggtggttttactcatagtcggaaatgcatcctttctgtggattgtgattcagaggaacagccccgcggcgaggggcgtcacgtaggcctccgtcagcgccgccaggatcagcagcggcagcagaaggaagaccagcagccgggccgccagccccaggcacgcgcccagaggaagagcggccggatcgcggcggcagcggcgggtcaggtgcccgcagatgtacagccccatggaaaaggccaggatcaaggcgggcagctcgaaaatcccgtggggcagcaggctggcggcatacagcagcatggtggtgtccgtggcggcatagcaggcggcaaggccgcccagcagcaccgcgttcacgcccagcgccagggccgggagacgcacaaaagggatcagcccatagagcatggtgacggcacaggcccgcagattgttggccagcagcagaagcggggagaggttcccggccccgtccgtcaggtccatgccctggaacaggtgctggagataggcggaaaagccgagccgcagctccggcaccgccagacacacgccgaaggccaggaagaccagcaggaaaaaggcgatggcggcgcgccggacctcggcctcatatccgttccgccaggcccggagcaccggggcgaactgggccgccagaaaccgcctcatgcccggagcttgtccaggcccagccgcaggcggcgcagggtctcatccttaccaaggatgtggcagatttccacggcgccgccgggggtcaccagcttgccggccgcggcgatccgcaccggccacatgagggtggcgttcttcacgcccaggtgttccgccagggcgatcagggtgtcgtggactgcgtccgccgtccagtcgccgatgccctccagggcggggatggcggcctccagcatggcctgggagacctcgggattcgtcttggatttcttgttggtgaagcactccacgccgtagtccggcagctggtcgaagaaatccaccttctccgggatctcggtcagcttctcacagcgggcctggagcagggcggccacggcggacacatcaatggcggggttcttcacggcctcacggatatagggctccgccgctttggcgaagtcctccggcgccatggcgcggagatacgtggcgttgaagtacgtgagcttgtcgatgtcaaaaatggcgggggacttggagataccggcgatatcgaaggcctccaccagctcgctgagggagaagatctcctgctcgctgcgctcgcccttgggggcccagcccagcagagccacatagttcaaaatggcctccgtcagatagccctgggccttcaggtcctcgtaggaggggtccccgtggcgcttggacatcttgttgtgctggtcccgcataacgggggagcagtggacgtaggtggggatgtcccagccgaaggcctcgtacagcagattgtacttgggggcggagctgaggtactcgctgccccgtaccacgtgggtgatgcccatcaggtggtcgtccaccacattggcgaagttgtaggtgggcaggccgtcccgcttcagcagcacctggtcgtccagggtcttgttctccacggtgatgtcgccgaaggacacgtcgtggaaggtggtggtgccctcgtgggggatccgctggcggatcacatagggctcgccggcctccacacgctgtcgggcctcctccggggacagatcccggcagggatcgtcggcgcggtcaaagtcaccggcgtcctcctcggatgcggccttctcgcagaagcagtagtaggcggcgcccttttccaccagcaggtgggcgtagggctgatacaggtcccggcgctccgactggatataggggcccacggggccgcctacgtcggggccctcgtcatgggtcaggccgcactccgccatggtgcggtaaattacgtccgtggcgccctccaccaggcggccctggtcggtgtcctcgatccgcaggatgaacgtgccgccggcgtgccgggcgatgagccaggtgtacagggccgtccgcagattgcccacgtgcatatagccggtgggagagggggcgaaccgggtgcggaccttccccttggggatgcgggcctccatctcctggaaaaagctctgatccaatgccatgcaaatacctccatatcgggtaaattacaaaaataacaacgtacattatcccctgaaacccttggaatgtcaagggctgattgtgtccggcggcacacgggcgccggacgcgggggcagggtgggggcggtatacatccgctccgggagatggtcgtccccggtgaccatggtcagaaacgtccagccgtaccgctcgtaaaaggcggtgtggtccgtcaccaggtagagccgggggatccccatggcgcccaggtcccgccggatgaagtccagcaggcgcccggcggtcccgcggccccgccaggggggctccacaaacagggcgcagagattgggcgtcaggtccttccggtcgtggaagtcgtttgcgatgacgccggccccggccagcaggcgcccgccgtcccggaccacgtaccactggggaaccggcgccttccggcggaggcactgctccatgctctcccggtaggactccgccgggattccccagcggcggctgaaccagacggcggccgcgtccgccaggacgggcgcgtcccgcagggggagaatgggctgttccatacggctcctttctgagactgcgaatatacagcaaaaaatcccgaaccgggtggttcgggatttcgtttgtccatgtcagaccgctctggtgaccttgccggaacgcatacaccgggtacaaacatacacatggcggggagagccgtcgacaattgccttcacacgcttcacattgggcttccacatccgattggaacgccgatgagagtgagagaccttgatgccgaacgtaacgcccttatcgcagaactcgcacttagccatccgttgcacctccttgctgttgcgtacttccatgccatctgcaggcacaactggtatcataacagaaaagttttgaaaatgcaagtaaaattttcaaaaaaacacaagcttttttcaactgtacgccaagggggcgtcagcgcaccgccgcttccccggcaaataccgccgcaacgccgaggatcaggcttgccgccgcatagagcagggccgccgccgtgcgcccgctttgcagaagatctccggtttccagggcaaaagaggagaaggtggtgaagcccccgcacacccctgccttcaggaagagcaccagcctggggtcgggggcggcccgcttcagggccagcgccgtgacggcgccgatgagaaaggagccgatcaggttgatggcaagcgtccggacgggaaagccccagtcccttcccagtggaatctgcccagccagataacggcacacggaccccaggaatcccctaagccccacggcaatacagttcagcatggacgccacgctccttttcatgtcatctgtggaaataccaccggccgcacctatggtaacacaaccggcggccggaggcaagagcccgccccgctccgacagaccggccggattcggccgcgggcacagggcccgaccgggaaaccggcagctgggtattgcgcaagcggtgagattcatatataatagagttacttccgcacaccggagcgcgggtgcggcgatccatccaccgcgccgggcgtgggcccggcctgggagaaaaccggcgtcccagtcccgggcgccgcaagaaaaggggaggacacgatgcaagaacatggcctgaagatctcggagctggtcacactcttcaatctggaggtgctgaacaggggcagcgactatgacacggcgctgctcactatcacggacgtgaaccgtcccggcctccagtttcatagcttctacgactactttgacccccgccgcctccaggtgctgggcaaggcggagatcacctatctcaaggggttgacgacggagcagcggcgcaagtgcttcgacgacctgtttctttacgacatcccggccctggtgatctcccgggggctggactgcttcccggagtgcctggagagcgcccgggtccacgagcggacgctgctgcggaccgaggagaccaccgtggagttcaccagccacaccatcgagtatctgaaccgggtgctggcgccctgcgtcacccgccacggcgtactgctggacatctccggcgagggcgtgatgattaccggcgactccggcatcggcaagagcgagtccgccattgagctcatcatgcggggccaccggctggtggcggatgacgcggtggagatccgccgcatctccaaccagctgatcggcaccgcgccggaggtgatccgccattatatcgagctgcggggtatcggcgtcatcgacgtgcgccagctcttcggtatgagcgccatcatggaggaatcccggatcgacctggtggtccagttcgagcagtgggacgagacgaagttttatgaccggctgggcattgaggatcaccacatcgacatcatgggcgtggagatcccctgcgtcaccatcccggtgcggccgggccggaacctggccagcatcgtggaggtggcggccatgaacaaccgccaccggcgttacggcttcaacgccgcccaggagctggcccagcgggtggacctgcgggcggagcagggcagccggaaacagaaatgagcggattcttcatcggtatcgacgtgggcggcaccaacctgaaggcgggcctgacggacgagacgggccgccttctggcggcggcgcgccgccccctggacttccgggggcggagacctttgcggcggacctggcggatctggcggcggaggtgctctccaccgccggagcggtgcccggggacgcggagggcgtgggcatcggcctgccgggggccgtctccggcggagaggtgctgtacaccaccaacatccccctggagcggacggatctggcggccctgttccgccggcggctggacctgccggtgctgctgggcaacgacgcggactgtgctgccgtaggggagtatttccagggcgcgggccggggtctgcgggacttcgtggtgctgaccctgggcaccggcctgggggccggaatcattctggacggccgcctgcggggcggcgaatcctccagcgaggcggggcacatggtgctccatgccggaggagagccctgcccctgcgggcgcaggggctgctgggaacagtacgcctccgccacggcgctgattcgccggacggaggcggccatggccgcccatccggagagcgccctctgccgtctggcagaagaggccggcggcgtggacggccggacgccctttctggcggcagaggcgggggacgagacggcccttgccgtctgccgcgcctatgtggaggagctggcggagggcacggccagtctcatcaacatcctccggccggaggcggtggccttcggcggaggtgtggccggggcgccggagcatctgctgctggagcccctgcgccgccgggtcggggcgctgtgcttctcccgccacggcgggcgggccacccgcatcctccgggcggagctgggcaacgacgccggcgtcatcggtgcggccctgctgggccgggtaatctgaagtatgaggaggtccagaaatggactggtggatcacatttgaccagcaggcggcggattatctgccggacctgcggatcgagaaggaggagcccatggaccggcacacctccttccgcatcggggggccggcccggcgcatggcttttccggagcggggagagcagctggtgctgctgctggacatggccgcccgctgcggcgcccgtcccctggtgatgggcaacggaaccaacctgctggccccggacgaggggctggaccggctggtgatcgacacctccgccggcctgagccgagtggaggccggcgggacaccggggaccattctggcggaggcgggggcctccctggcccgggtggcggatttcgcctgccggcaggggctggcgggcctggaattcgcccacggcatcccgggcacggtgggcggcgcggtgtgcatgaatgccggcgcctacggcggggagatggcccaggtggtgcgggaggcaaccctgctgctgccggaggagggcatccggaccctcaccggggcggagatggccttcggctaccgccgcagctttctgacggatcacccggatgcggtggtgctgcgggcggagttctgcctgacgcccggcgacccggcggcaatccggggccggatgaaggagctgctggaaaagcgcagggccagccagccgctggagttccccagcgcgggcagcaccttcaagcggccggagggctattacgccgggacgctgatcgaccaatgcggcctgaaggggctgacggtgggcggcgcccaggtcagcgagaagcatgcgggctttgtcatcaaccggggcggcgccacctgcgccgacgtgaaggagctgatccgccagatccaggagcgggtctttgcgcaggccggcgtccggctggagccggaggtccggatcatcgactgagaaaggggcggtgcggacatggaaatcctcatcatctccggcctctccggggccgggaagagcaaggcggcctcctttttggaggacatgggcttttatatcgtggacaatatgcccgccgccatgatcctgaaatttgcggagttctgcgccgggggcaacggccgctacgaccgggtggccctggtgtacgacgtgcggacggccagctccttcacggagctgttcgacgtgctggataagctgaaggacatggaggcccagtgccggatgctgtttctggaggccgcgccggaggtcatcatcaagcggtacaaggagacccgccgccgccatcccctggcggcagacaccgactccctggaggaggcggtgaagaaggagagggccatgatggcccccgtcaaggagcgggcggactttgttatcgacacctcccgcacctccaccgcccaactgcggggagagctgctgcgcctcttcggccaggagggggagaaggggggatgacggtgagcgtcacctccttcggcttcaagtacggcctgcctctggaggcggatctggtgtttgacgtgcggttcatgccgaatcccttctatatggaggacctgcgtccccggacggggctggaccaggcggtggcggactatgtgttccacttcccacagacccaggactacatgcgccgtttggaggacctgctggccttctccctgcccctgtacgcggaggagggaaagacctctctcaccatcgccgtgggctgcacggggggcaccaccgctccgtggcggtgacccatgccctggcgggcttcatccacggcctgggctatcaggtgctggagaaccaccgggacatgacccggggaggctgagccgtgagggagcaggaataccgcgtcccccgggcccatggccccaaggtggccgtcatcggcggcggccacggcctgtccaacatgctgcggggactgaagcaatatacggagaatatctccgccatcgtcacggtggcggatgatggcggcggctccggcatgctgcgccaggacctggggatgcctccgccgggggacatccgcagctgtatggaggccctggcaaacacggagccggtgatgcgggagctgctccactaccgcttcaccgaggggagcctggcggggcagagcttcggcaacctgtttctggcggcgctgaacggcatctccccgtcctttgacgcggcggtgcgccgcatgagccaggtcctggccatcaccggacgggtgctgccggtgaccacggcggacgtgcagctggaggcggaatttgagaacggcgccacggtggtgggggagtccaagatcttttactgcaaaaagcaggaggactgccgcatccgccaggtgcgtctgatcccctcccggcccaaggccctgccggaggcggtctccgccatcgccgacgcggatatgatcgtcctggggcccggcagcctgtacaccagcatcatccccaatctgctggtggatggcatcgtgaaggcgatccgggagtccgacgccctgaaggtctatgtctgcaacgtcatgacccaggagggggagacggagggctacaccgtatccgaccacatcgccgccatcttcgcccattcggcgcagggcctgttccgcctgtgcctcaccaactcctcgcccatccccaaggcggtggccgcccggtacgcggaggagggggccgagcgcatccgatgcgacaagtccgcctgcgcggccctgggcgtggaggtcgtggagcggccggtggccacggtggagagcggctttgtccgccacagctccgcggccctggcccgggagctgatcctgctccatgcggagcggagcgtccggatcgccggtgcccgattccgcccccgggaggactcctaccagatggaggagcagaaatgagccccacaattacccagagttggaggagacccacccatgtccttttcctttgaagccaaaaacgagctgtgccgcctgccggtgcagaagctgtgctgcgcccgggcggaggcctacggcatcctgctgtactgcaacaccttcagcgcaagcgaggtgcggatcatcaccgggaaccccgctctggctgcccggcttcccaagctgtttcaccgggccttcggcctgcggttcgaccggctgccggaggagggggagagcggcaagctggtgttccagatcacagacggcggcaagctccgccggatcgtggacctgctgggcttcagcccggagcagaacctggccctgcacatcaacttcggactgctggaggaggagtgctgccgggcgtccttcctgcggggggtgttcttcgccgggggcagcgtcacggacccggccaagcggtaccacctggagctggcgacctcccacctgcaggtgagccgggagctggaggtgctgctgcgggagtgcggctatccccccaagagcgtggcccgcaacggcagcttcatcacctacttcaagcagagcgaccagatcgaggacttcctgacgctgatcggtgcgcccgtggccgccatgagcgtcatgtccgccaagctggaaaaggacctgcgcaacagcgttaaccgccgcctcaactgcgacagcgccaatctggacaaggcggtggaggcggcccaggaacagctggaatcgatccggaagctccagcgggcgggcctcctggaccagctgccggacaagctccagctgacggcggccctgcggctggagaatccggagctgaccctcagtgagctggcggaggagtttgacccgccggtgaccaagtcctgcctgaaccaccggctgcggaagatcacccagctggcaaaagggctgtaaagtaaatgcgctttacaatttatcaaagaaaagttggaggaatatacaatggatcgctgtgcggcagcctatgcatatcacaaacaggggtataactgtgcccagtctgtggccggggcctttgcggacctgacgggcacggcgccggagcagctgatggccgccatgggcggcttcggcggcggcgtgggcggcagccatgaggagctgtgcggcgccgtcagcggcggcgtgctggtgctgagtctgctgcacccccatacggacggagaggacagggccggaaaggtgcgcctctacgcccaggccaaggagttccgccgccggttccaggaggtgttcggcctgacccggtgcggagacctgctgcgggcccggcccggcgtcacagagaggaacccggcctcccagcggctgggagtcaccgcccactgcgacaacatgatcgtcacggctgtggagatcctggagcagatgctgcaggaggagcccgcatgacctgggcagagctgtattcagaggctgcgcggcccacgctggaggaaatcgacgcctatgcgcatacgcccctttggccgcagctgcgcgcgtatctggcggcggcctatggagcgggaccgcggctggagtacagccggtgcggtctggagccgggatggaatgtgaagttccgcaggggcagcaagtctctctgcacggtctacctgcggcctgggtttgtgacggccatggtttctgtcgcgcccaaggatgaggaggccgcccagatggtcctgctcacctgcacggcagagacacaggcggtctaccatcggtccgctgcatccaaaatgggccgctggctcatgctggacatcacgtcaccggagatgctggaggatgtgaaagctctgctggccgtgcgggtcaagcccgcagagtgagcaccccgccctttgcaaggacggcgcgtgcgattttggaaaggaacatgctatgtcttttgtccatctccacgttcatacggaattcagcttattggacggcgcctgccgcatccgggacctgcccggcatcgtgaaggccatgggccagaccgcctgcgctgtcacggaccacggcgtcatgtacggtgccgtggacttttaccgcgcctgcaaggcggagggggtcaagcctatcatcggctgcgaggtgtacgtcacccccagggccggacccggttcgacaaggtccacgagctggacgcggagagccgccatctggtgctgctctgcgagaacgaggagggctaccggaacctgtcctacctggtgtccatggggtggacagagggcttctatatcaagccccggatcgacctggagctgctgcggcagtacagcgggggactgatcgccctgtcggcctgcctcgccggggagatcccccggcggctgcggaacggggagtacgagaacgccaaggcctatgccctagagctctcccacatcttcggcccggaccgcttctatctggagctccaggaccacggcatccgggaccaggccatcgtgaaccagggcatcctccgcatccaccgggagacggggctgcctatggtgtgcaccaacgacgcgcactacctccggaaggaggacgcggaggcccacgatgtactgctgtgcatccagaccggcaagaccatcgacgacgagaaccggatgcgctatgagccccggaacttctacctccgcagcgaggaggagatggcggccctgttcgcgggctacgagggcgcgctggagaacacgtcgaagatcgccgacatgtgcaatctggacttttccttcggcaagtaccacctgccggaattccggctgccggaggggtacgacagcttctcctatctgaaaaagctctgcgacgagggctatcgggagcggtatggaacggacgaccagtaccgggaccagctccggtacgagcaggacatgatcgagaagatgggcttcaccgactacttcctgatcgtctccgacttcgtccgctatgccagaagcgcaggcatccccgtgggtcccggtcggggcagcgccgcgggcagcatggtcagctactgcctccacatcacggacatcgaccccatgaagtacaacctgtacttcgagcggttcctgaacccggagcgggtcagcatgccggatatcgacatggacttcggcgacacccgccggggcgaggtggtggactacgtccgccggaagtacggggatgaccacgtggcccagatcgtcaccttcggcaccatggccgcccggggcgtgatccgggacgtgggccgggtgatgaacatgccctatgccgacgtggacgtgatcgccaagcaggtgcccgccgggcccggcgccctccacatcaccctggacgacgccctgcgcctgtccaagcccctgcgggagcagtacgagaccgatgagcaggtgaaaaagctcatcgacaccgccaaggccctggaggggatgccccgccacgcctccacccacgccgccggcgtggtcatcaccaagcggccggtgtacgagtacgtgcccctggcgaagaacgacgacgccgtggtgtgccagtacgtcatgaccaccctggaggagctgggcctcctgaagatggacttcctggggctgcggaacctgacggtgctggatgacgcggtgaagatggtccaggagcgcctgccggacttcaagctctcggacatcccggaggacgacccggagacctttgagatgatctctgccggcaagacctccggcgtgttccagatggagtccgcgggcatgaccggcgtgtgcgtgggcctgcggccccagaacatcgaggacatcaccgccatcatcgcgctctaccgccccggccccatggactccatcccccggttcatcgcctgcaagcatgactccagcaagatcaagtacctccacccgtccctggagccgatcctctccgtcacctacgggtgcatcgtctaccaggagcaggtgatccagatcttccagcagctggcgggatactctctggggcaggcggacatggtgcgccgggccatctccaagaaaaaggccgcccagatcgagaaggagcgggaggcattcctccacggcgatccggagcggaacattgcgggctgcgtggcaaacggcatcccggaggagacggcccaggccatctatcaggatatctacgactttgccaactacgcgttcaacaaggcccacgccgtctcctacgcggtggtggcctatcagaccgcctggttcaagtgccactacacccgggagtacatggcggcgctgctgaccagcgtgctggacaactccgataaggtggcgggctacatcagcgagtgccgggactgcggcatcgccctgctgccgccggacatcaaccgctccgccgaccggttcaccgtggaggaggggggcatccgcttcgggctggtggccatcaagaacatcggccggggctttatccaggcggtgatgcgggagcgggagcaggcgcccttcacgtccctctacgacttctgcgaccgaatggcgggcagcgacatcaacaagcgggcggtggagaacctgatccgctccggcgccttcgatgccctgggggccaggcggtcccagctgatccaggtgtacgagtccgtcatggacgcggtggcggacagccgccgccagaacttggaggggcagatggatttcttctccctggcggacggcagcagcggcgggagaaagaatgtgaaggaaatccccttgccggacatcgacgagtacaccccgaggaacggatgctgatggagaaggagaccacgggcctctatctctccggccaccccatggaccagtaccgggaggcggtgcggcggctgggggcgcccactatcggctccattctgggagacttcgcccaagagggcggccccacacggttcgccgacgaccagcggatcaccatctgcggcatcgtcacctccagcaagacgaagaccacccgcaacaactccctgatggcctatgtgacggtggaggacgacaccgcctccatcgagctgctgtgcttcgcccgggtgctggagtcctgcgggccgtacctgaaggagaaccaggcagtggtggtgaaggggcggctctccgtccgggacgagaaagcgccccagatcctctgcgacagcgcgtatccgctctctgccgcaggcgctccggcggcggaagggcaggccgcgaaagcgccggatcaggtgctgtacctgaagttccctagcctggaccaccccagcgtgcgccacatgaagctggtgttccagatgtttcccggcaacgccgctgtgaagatggtgatggcggacacccgcaaggtctacggcacccatgcaagcctccacgaggccctgctgcaggaggcccgggagacgttgggagaggccaatgtggtggtgaaatagaacggaacgcccgtgtccaaaaggacacgggcgtttttcattcacaagcgccgtttcagcttcaagaccagctccacaaccccggcgcccagggtcaggcaggcggcctggatggtccagagcattggcccttcactgccggggatggggattgtgctggcccagaggaaaaggatcagggccaaagctgccgcccccgctgtcagcagccagccgcgccgccagcggcgcagcagccagcggaacagcagaccggccagaagggggaagaccgcgacgagcatccagttccatacgatctgaagcaagagaatccctccttatctcccaaaacgggccgacaggccgtggagcggggacccggcggccaggagaaggagccccctcgccgcccctccttacggggcctcgtcctcgggctcggaggacatcagggcccgcatgatctcgccatacagccgctccggggatttctggaaccgctccgtcagcatggcggccatgtcctcccgggggatggccagccgcaggtccatcacgctgcccatgtcgtccgacagctccagccgcaccgtgtaggtgccgttgggccgcttctccgtggaggccttcacctggctcttgcgccgcaggtggcggttgcaggccgccaggttcttgtcgcaccgcagccgcacggagtaggggaggctggactcgcagatccggctgttccgcaggcccttgtcggtgatggcgtacagcccgtccgcagacagcgtcagatgctcagtccgcaccagatcggagaggcactcggcaaagtcgaaatagtccacgccctcgtcgcacatggccagatcccacacggtatcaaagggaatcggctcgatcacccgggcggtgatatacagaatcagaaacttgatctccagcttgtcatggataaagccgggcatccgcgtcacctccttggaatgggattggatacaattgtattataccgcaggaccgccgggtttgtatagtccgaatttccccgccgccgcaccaatgggagccgggcgcatacactggattgaaagagcttctctttcatccagctacttattaggaggtattgcaatgcccgagaaagttatgcccggtcccgtggaggactcctgcggcatccgggaggcggtttgcatccataccaggaagatttttgattcctgccgcgataaggactgcatcgaggacctgcggttttaccccaagctgcagtgtgtggacatcatcaaccgcgccctgtccgtgaagggcggcagcgccaagctgctgtacgtctatgtggatgtggagcccgtcagcttcaaccggggcttctacaccgtggatatgcgcttcttctaccatgtgacgctccaggcctatctcagctgcccggtgccggtgacggtggagggcctgtgcgtctttgacaagcgggccatcctgttcggcagcgaggggaacgccaagatcttctcctccgagatgcgggccggagagccggatccccagatgatgcagcggtccaacacgcccatcgccgtggtggaggccgtggaccccatcgtgctggacgcccgcatcatggactgctgctgcaagcgggactgcgactgcgacctgtgtgaaatccccaccttcgtgggcgactgcttcggcggggagctgtccagcggggacgacagccgacggatctatgtgaccctgggccagttctccatcgtccggctggagcgggacacccagctgctggtgcccgtctacgactactgtatgcccgacaaggagtgcgcctgcggcgacggctgcgaggacccctgcgctctgttccggaacatctccttcccggtgggcgagttcttcccgcccaacaccgtcaagcggccggagagctgcgacgacatcaagagctgctgcaagtgagcggcagaccaacaggaccccggctgcttgccggggtcctgttttgctacatcctgtgccggtaccagagggtgaggccccattccagaagcccccaggcgaggcagaacccaaccagcccccaggtgatccacatgggcagctccagaaagcgggcataggccgcgccgaaatacaggaccgcgccctgcatgacccgggcggcccgggccgccgccttttcgcagatcatggtgttccgctcgtcgtgctgttctttgtaagcctgaacgagtaccgggtcgcgaatccgaatgacccgacacagcagggagccgagggaaccgcccaccagtacggacccacccgcagccagcagagcaaagacgggcttggggagatgctgggggaattggagcgggaccgcgcacagcagaagccccgccgcgatcaacagcagataccagcgctttttcatcccggcgcaccccttacatctcccgctcgtagcggatcatgagatacagctccagcacggatttggctacgaagacaccggtggcagccagggggacccacaggggcgcatccaggccgatggagagccatgccgccgccagaacgttccactggaggacctcgccggacacggccttggcccggttccggatagccacattccgctcgtctttttgttcgatgtcgtgctgccgggccatctccgggtgcttcgcctcgtggcggaggttcagcagggtggaccccgccatggccagcaggccggagcctatgccgcagagcatcccgcccagggaatcgggcacccggccgtccagcagcagggacaggaccagcaggacgatgcccatggccagaagtccctggaacaggcgctttttttgtgtgcggttcatacagagtccctccttcaatactgacggcggtaccagacggtgaacatccagtccagaagcagttttacgcaggccaggcccagcagggtgatgttgacccacttgggcacgccgaagaagtacaggtaggcagcgccgaacagcagcagccacagcagcacgtccccggcccgggccctggccatggcccggatcatggcgccccgctcgtcgtggtcctcccggtcccgctcccgccgggcggggtccaggtctcgggtggacagcagctccgccatggcgcagaagaacaggaggccgcctgcaaggccaaaaaaccccggcacagcggcgggagcggcgggaaacgtccgcgccgcccagagggcggcccccgctagcagcgcccccgccgcggcggccgagagataccagcgtgtgttccgcttcatgacagcgcctcctcacatcttccgctggagccatttgtaaagccccaggaacgccaaagtgtaaaacagatagatgccgatgaacacccagcccacccagtcgggaatgccgaaccgttcaaagctctggaaaatcaggccggagaccaccagcagtccgacggtccaaaatccggcgatgcagccggcccggtcccggatggcctggttccgctcgtcgcattgggccttctgcctctgccggtagtccgggtcccgggagagccgtttcagctggagcaacgtcccggcgcaggtgccgaacagcaccgccccggccatacccagcagggaggccgcgccgccggagagaccgggcgcacccggcgcattcaggacgaacatcgggatgcagcagagcagccccgcgattgccagggacatcaatatgacctgcttcttcatgtgccatcctcctcatagatgaaaatgtcctcaatggtggtgccgaagtaccgggccagcttgaaggccagcaggatggaggggttgtaccgcccgttttccaacgacccgatggtctggcgggacacctccagcgcctccgccagctcctcctgcttgatccccctggccttgcgcagcgcctccaggcggtttttcaagggcgattccccctttcatacgccccatccgcttctgacggatggaaagtttgctttccgtcttcaacttagcacacttccggtaccatgtcaagtacgctttccatttttccgggcttgtcccatttttccactgagggagtcatatccggggacaacccctcatagagtatagcgtgttacgaaagggggcgcggcccgtgaaggaggaagaacgccgctatgaggaggcggcccgggtgctgccgggccgcctgcgggaacaggctctggcccagccgccggaggtccggcagatggcggaggagttccgcctccgggcggggcagccgctggcggtgctgctgccggagggggagcggtccctgggggccgccgtgacgccggaggatctggagactctctgcgaccttgccaccgactactcccgctatgcggcggaggagaccctgcgggaggggtatctctccgtgcggggcggcttccgggtggggctgtgcggcacggcggtgatgaaggacggggagagcaccgccctgcgggacctgtcctccgccgctgtccgcatcgcccgggagcagagggggatcggggaggcggtggcgccccggctgtttcgggacgggcggtatcagaacaccctgctgctgtcgccccccggcggcggcaagaccacgctgctgcgggatctggtgcggtgcctctcctccggcggcaccggcaggccgggtctgcgggtctcccttatcgatgagcggggggaggtggcagtgatggtccgggggaggccccagatggacgtggggccccggacggacgtgctggacgcctgccccaaggccctgggcatccccatggccctgcgggccatgaacccccaggtcatcgccgtggacgagatcacggcggaggcggacctccgggccgccatgcaggccgccgggtgcggcgtggggctgctggccaccatccacgccgccgatgccgcagagctgacccagcggccgctgtaccggcagctgctggcggagaaggtgttccggctggcggtgcgcatccgccgggatgaggccggaaggacatacgaagtggaggaactgccatggtgaagctggtgggcgcggtgtgtatcctgggggccgggacctgggcctggcggcggtcggcggcggagcgcaggcgggagttggacacgctggcggacctgaccgccctgctggaccgcatgggggaggagatccggctccgccggaccagcctgccccggctgctggggtccctgggccgggaccggacgggacctgtccgggacttttgtacatcggtggcggcgtcgctggcgcggggcgcgcccctggggcagagctggcggtccgccgcggaggcgctgcccctcggtccagagagccggaccgccctgaccgccctgggagattccctccagggggatgaggagagcgtatgtaaagcattaacccttgccggaaagatcctggaaaaaaacctggcggcggcccgggaccacaggcaggagacggagaagcggtccgcggcgctgtggctttccagcgcggcgctgctggtgattttactgatttgaggatagacgcatggaagtggatttgattttcaagatcgccgccatcggcatcctggtggcggtgctgaaccagctgctgatccgctcgggccgggaggagcaggggctgatggtggtgctggcagggctggtgtgcgtgctgatgctgatggtccgagagatcagcgacctgttcgacctcatcaagtccctgttcgatttctgacatggagcaggtcatccaggtgacggggctgtgcgtggtgggggcgctgctggccctggtggtgaagcggggcagtccggagacggcgctgctgctggcggtgggggccgccgtggtggtggccctggccctggcgggcgtggtgaaggagctgctggccttcctgggggagctggggtcggccagcggcgtgtccgcggacctgtttgtgcccctgtacaagaccatcggcatcgccctggtggtgcaggtgggaggcaacctctgccgggacgcgggggagagcgccctggcctccgtggtggagacggcggggaccctctgcgccctgctggcggccctgccgctgctgcgggcggtgctggacatgctgttggagctgatgggatgaaatggtggatctgtttgacggcgctggtgctggcgctgaccacctccgccgcggcggcggacctgccggcggagctggagcgggccgccccggaggcggcggaggatctcacgggcggggacctctccggcgggacaggctttgcccagggggtggggaacattttagaccggctggcggaccaggtgggggacgtggtccgggagcgcacccggggcgcggcggcggtgctgctggtggtggtgctgtgcggcgtggtggagggcttcgcccaggggaccgggggaagggggcggcgttcctgcccatggcgggggcgctgtccatcaccctggcctccgccgggagcctggactccctgatggggctgggcagccggaccatcggggagctggcggacttctcccaggcgctgctgcccaccctggcggcggccacggcggccagcggggccgtcaccaccgccacggtgcagcaggtgtccacggtgttcttcgtggatctgctgctgcggctgatccggcagctgctgctgccgctggtgtacctgtacatcggattgctgacggcggcggcctgcctgccggaaaaccggctgggggccattgccgaggcgctgaaaaagctggtgacctggatcctcaccacggcgctgctggtgttcaccatctacctctccatcgtgcggatcatctccggctccgccgacagcgccacggtgaaggtggcaaaggccgccatctccggcgtggtgccggtggtgggaggcatcatcgccgacgcgtcggagacggtgctggccggggccgggatgctgaagaacaccatcggcgtcttcgggatgctggccatcctggcggcctgcgcctatcctttcctgcagctgggggtccagtacctgctgtacaagctgacggcgtatctggcctccgtggtgggggcgccggggctgtgcaagctcatcgacgggctgggaggcgccttcggcctgattctgggcatgaccggcggctgcgcgctgctgctgctcatctccgtgctggcctccgtgggggcggtgatgccatgatggaggcggtgcgggcgtggctgacctccgtggtactggtgtcggtgctgctgtcggcggcccagagcctgatcccgccgggcaccgtgcggaaggcggcgggcttcaccggcgggctcatcctgctgctggtgctgctgcggccggtgctgggggcagacctggagcatctggagctggatttcgaccactaccaggcggcggtggaggaacggcaggaggagctggccgacacacagaccgaggccatggcttctatcatagcggagcagacagaagcatatatattggacaaagcgggcgagctggggctggaggtgaccgtccgggtggagacgcggacggagggaaacggcatcccggtgccctggtccgcggagctgacgggcagctggtcgcaggcgctggcgtcggcgctggagacggaactgggcatcccggcggagaggcaggtttggcatgagcgggaagcagaaaactgaaggagtgcgaaggatatgggacaagtacaaattcgtggcgctggtggcgctggcgggagccgtgctgctgctgtggcccggcggggacgggaagacggcggagcgcgcctcgccccaggcggccgccctggtggaggcggagctccagcaggagatggaggacattctgggccgcatccagggcgtgggggaggtgcaggtgctgctgaccgtggaatcggacggcgagcggcagctggcacaggactcggagctctcttacagcggctccaccgcggcgccggaggactactcccgttcctcccagaccgtgctggtggatgacgggagcgccgaggcgccggtggtgacccggacggtgtatcccacctatcgggggccctggtggtgtgccagggcggggaccgggcggacgtgaagctggcggtgacggaggcggtggcggccctgaccggcctttccgcagaccgcatcaccgtggcaaaatcgcagtgatgatttggaggaggagacagcccatgagcgcgagatggaagcggaataccgtggtggccacgatggtgctgctggtgtgcgcagcagtggccctgaactggaagtacaccggcgagcaggcggcggacgccgtggaggagaccggcaccaagatcctgggggaagccacgctggtcagcggtcaggaggacggcggcgaggccgggacggatgaggaggcggtctacaccggcggggactacttcgcctccgcccggctgacccgccagcaggccagggacaacgccatctccctgctgcaggaggcggcggaccagtccggggccgacgcggcggtggccaacgaggcgtcggagggcatccaggtgctggcgggctacaccatgaaggaggcccagatcgaaaacctggtgaccgccaagggctataccgactgcgtggccttcatgggggaggacagcatcagcgtggtggtggacaccggcaccggcgagctgacggccgaggacgtggccaagatcaccgacatcgccatgacggagaccggatacccagccagcggcatcaagatcatggcctcaaattagctgttgtattttcccgggaaacatggtaaaataacaccctggaaccattcttctgggacgcggcgggcgacccccgtctctaccaaggatcaaacagtgaggagaggcttacgatgggcgagagcaaagagtatatgacgctgccggaggagaacgggagcatcaacatttccgaggaagtgattgccgccatcgccgtgggcgccgtccgggatgtggagggcgtgtccggcatggtgactgccatgggcggcagcgtcacggacctggtccacaacaagaagaacgcccagaagggcgccaagggtgtgaagatcgacatgaccggcgccgccctggtgctggacatctatctgacggtggagtacggccaccccatccccacggtggcggaaaatgcccaaaaggccgtcatcggcgcggtggaggccatgaccggctgctctgtggaggcggtcaacatccacgtgggcggcgtgacgctggcctgagtcccggatgggaatgagagagaaaaggacgtagttgaggttatggtacggaacaccgcgcgagagatcgccattcatctgtcctacgagctgagcttcaccgacaagccggtggaggagctgctggacgagcgcctgacaccggagtccttcgccgccctggcggaggaggacccgctgtatcaggagacgcccaacgccaagcaggcggactacatccgccgcctggtgcggggcgtggccgaccacgctccggagctggacgggtatatcgccaaatacgccaaggggtggaattttgcccggatccccctggtggcctccgccatcatgcgggtggccatgtatgagattttgtacatgccggacatcccccacggcgcctccatcaacgaggcggtggagatcgccaagaagtatgagacgccggagacggtgaagttcatcaacggcatcctgggcaccttcgtgcgccgggagacagcggaataagggcagtcctgcggagcgggacgggggcgtgacgccgccgtccggctcctcgttttctgcccgcagggaccaaggagcaaacgcgtatggaaccacatatctatggtgtcacagaggtgaatcagctggtgaagggcctgctggacagtgccccggctttacagggcgtcgccgtccggggagagttgtccaactacaagatctacccctccggccaccactatttcaccctgaaagatcaggagggggccctccggtgcgtcatgttccggggacaggcctcccgcctccggttccggccggagaacggcatgaaggccgtggcctccggccgcatcaccgtgttcccccgggacggggcctatcagctctactgcgactccctgatcccggagggggtgggggacctggcggtggccttccagcagttaaaagaaaagctgtggaaggagggcctctttgaccctgcccacaaaaagcccctgccgccctatccggagaaaatcgccatcgtcacctccggcgccggggcggcggtccacgacatgatccgcatcctccgccgccggtatcccatcgccagggtgatcctgctgccggtgcgggtccagggggccgaggccccgccggagatcgtgggggccatccggtacgcggacaggtggaagatcggggacgtcatcatcaccggccggggcggcgggtccatggaggacctgtgggccttcaacgacgagcgggtggcccgggccatctacgactgtgagacgcccatcatctccgccgtgggccacgagccggacgtgaccatcgccgactttgtggcggatgcgcgggcgtccaccccctccaacgcggcggagatcgccgtgccggaccaggtggagctgctgcggtggctccggggcgcaggggagcggatggcgagaagcgagacggcgcggctggagaccgcccggcagcggctcaccgccctggcggccaagcgggtgatgacggacggaatggcctacgtccaggacaagcggctggacctggaccacttacagcagcggctgggggacgtgaccggcgcggtgctggggcggcaccggcagaaattcgcggccctggcggcgtcgctggacgccatgagcccactggcggtgctgggccggggctacgccgtggcccgggatgagcaagggaagatcttgaaaagctggcgggagacggcgccgggcagccgggtgtccgtcacgttgggagagggcggcttcaccgccgtggtggacaagccctatacgaaggaggaacagccatgagcgcgaagaaacagacgttcgagcaggagatcgcccggctggaggagatcgtggcggcactggagaagggggatgcccccctggcggactctctggcgttgtttgaggaggggacgaagctgatcgccgcctgctcccaggagctggacgcggcggagcagaaggtggtcaagctgatgaagggccccgacggcgcgccggtggagctgcccttcggagaggaggagcagggatgagcgaacaggtgtttcagacccggtatgagacctaccgcacggcggtggagtcgtatctggagaccctctttgccgggagtccggactggcgggacctgtatgagtccatgcgatacagcctgctggcggggggcaagcgcatccggccggtgctgaccctggagtttgcccggctggcgggccttgcggactggaagacggccctgcccatggcctgcgccctggagctggtccacacctactccctgatccacgatgacctgccctgcatggacaacgacgacctgcgccggggcaagcccaccaaccacaaggtctacggcgagacgctggccgtgctggcgggggacgccctccagccggaggcctaccgcctgatcctgacggcgccggggctggacgagagccgccgggccgcctgcggccgcatcctggcggaggtctccggcgcggacggcatggtggcgggccaggtgctggacaccctccacgccccgaagaccgaggcggaggtgacggaggtccaccggctcaagaccggggccatgatcgccggggcctgccgcctgggcgtggccgcggcgggcggaagcggcgggctgatggccgccgccgaaacgtacgcccaggagctggggctggccttccagatccgggacgacatgctggacgtgtgcggcgacgcggcggagttcggcaagcccatcggctccgacaaagaggaggggaaggtcaccttcatggacctgctggggctggagggctgcggccgggcggtccgcgcccatacggaggcggccaaggccgcggtggcggactgggacacggacggcatcctggccgccctggcggactccctggcggagcggaacaagtgaagagcggggccgccggacggcggccccttttctgtccggcgccggggactgtccgcatcgggaggacagcccggccggtcacaaaaaatttacggacgcatatacggaatatgttgtatatttattagatttgtgatatactgtatggcgctaagcggcggcgcagtattctagtcagatcatccgtctccgaaggaggggctaaaaatcctctgaagggcacaccgatgaaacctctggtgcctgcttgatacgcccagtttcgggtgggtgctggggggaagcctggctttgcctgcgcttgcggactcagggcgctttccaatggcatggtgatgacgaccctgtttccgtggagacctgttcttgtgcgcggacgtactcccagtgtggtattccgggccgcgtacgaagcagctgatgaacctgcagcgcggtgcatcggccctgcggggccgtaacgctgtgtgcagacgtagcctgccttgcgtgaggcgggtggatgggggaacaacaggcggggccctctggccagagggcccgtttgatcgccccctgaaacccggtttgcaaaagaggctaaagggacggatcgactggggtggaaatcacctaggctgtcctgaccgggctgaaaagggattgcagtgcggactaagtggcgatcgggtggcatggctggcgacactgtgccgcggcaccgaagggggaaccgcctccatcggcaacgagaggtgtgccgcggggaaatccaacccgtacctaagccgtaagatttaccttttccgccgccgccgacttagccaactggaattcattcccaagtggagggactttttttgagcgataccccaaagcgaaagcgcggacgggagcgggagaggccgggcccctaccggtgggccgtgcaggtcttttttcttgccatcgtcctgtctgcggcattgagccttgcgtcggaaaccagtctcagcggcgcgggcgcggcggctgccgcgctggtgctggcggtgtttatcggcctgggcatcctgttcgacatcatcggcgtggcggtcacggcggcggaccccaggccctttcactccatggccgcccacaaggagcccggcgccaaggaggcgctggtcctgctgcggaacgccgggcgggtgtccagcgtctgcaacgacgtggtgggggacatctgcggcatcgtcagcgggaccaccactgccgtgatcgtggtgcggctccagacggcctttgccctgccggagagcgtgctgctgagcgtggcggtgacggccctggtgtccggcctcaccatcggcggcaaggccctgggcaagacagtggccctgaacaaaagcaccagcgtggtctactgggtgggaaggtttctgcacctgttccaccgctgagaggaggctgggtcatttgatcttagagaatatccataccccggcggacgtgaaggccctggaccgggaacagctggagcccctgtgccgggagctgcggcagttcctggtggagcatgtgtccaaaaccggcggccatctggcctccaacctgggagcggtggagctgacggtggccatccaccgggtcttcgacacatcgaaggaccggctggtgttcgacgtggggcaccagtgctacgtccacaaggccctcaccggccggcaggcgctgtttgacaccctgcggcagttcggcggcctctccggcttccccaagccccgagagagcgaacacgacgccttcatcgccggacatgcctccaactccgtctccgtggcccttgggatggcaagagcaagaactttacagcacttggattacagtgttctggcgctgatcggggacggcgccctgaccgggggactggcctatgagggcctcaacaacgccggtgcctccggcgagcccctgatcgtccttctcaacgacaacggcatgtccatcaaccccaacgtgggggcggtggacagccatctgagccagatccgctccaagcccgcctactaccatttcaagaagtggtaccggggcctgttcggacagcaccccatggagaacccgctgtaccggttcaaccacaaggtcaagacgtccctgaaaaaggccctgtggcccggcagcaccctgtttgaggacatgggcttcacctacctggggcccatcgacggccacgacctggaccggctggtccacgtgctggcctgggcccgggagctccagtgcccggtggtggtccacgtgaagaccgtgaagggcaggggctactccttcgcggagcagaacccggacaagttccacggcgtggggccattcgatccggagacgggccttgtgaagaagagcgggggagacgacttctctgccgtgttcggcaggacgctggccgcctgcgccgcggaggacgggcgcgtctgcgccatcaccgccgccatggcggacggcaccggcctggccccctttgccaaagagttcccggaccggttcttcgatgtggccatcgctgaggggcatggcgtcgccatggccgcgggcctggccaagcaggggatgctcccggtgtttgccgtgtactcctcgttcctccagcggggctacgacatgctgatccatgacgtggccctccagcggctccatgtggtgctgggggtggaccgggcgggtctggtgggggccgacggcgagactcaccacggctgcttcgacgcgctgttcctgtcggagatccccgggtttacggtgctgtgccccgccagctttgcggaactgcggcggatgctgcggcaggcattgtttgagatcgacgggcctgtggcggtccggtatccccggggcggcgagggcgattaccgggaggaccggtccggtgcgccggtggtccggctccgggagggggaggacgtcacgctcctcacctacggcgtgctggtgaatcaggccctggcggcggcggacctgctggaacggcagggcgtcaggaccgaggtgctgaagctgaatcagatctcccccctggagtatgagacgctggcgccctggctggcggggaagaagctgctggcagtggcggaggatgccttcggcgccgggtgcgtgggccagcggacggcggccatcctggcccagcacggccaggcgccggagaagctggtgctcatcaacctgggcaagaccttcctgccggagggggccgtgccccagctggagcatcaggcaggcatcgacgccgcgggcatcgcccgggcggtacaggaggcgcgtacatgagtgaaaaaaaacggctggacgtcctgctgacggagcggggccttcaggagagccgccagcgggcccaggcggtcatcatgagcggcgaggtctttgtgaacggccagcgggtggacaagcccggcaccgccgtggcggaggacgcccagatcgaggtccggggcggcacgctggcatacgtcagccggggcgggctgaagctggagaaggccatggccgccttccccatcgacctgaacggcgccgtctgcgccgacatcggcgcctccaccggcggcttcaccgactgtatgctgcaaaacggcgcggagaaggtctacgccgtggacgtgggctacggccagctggcctggaagctccgcagcgaccccagggtggtgtgcctggagcggaccaacgcccggtatctcacccacgagcaggtgccggacgagctggacttcgcctccgtggacgtgagcttcatctccctgaagctgatcctgccgcccctgaacggcctgctgaaggacggcggccacgccgcctgcctggtgaagccccagttcgaggccgggcgcgagaaggtggggaagaagggcgtggtccgggacccggcggtccacctggaggtgctggagcactttctggaccacgccggggacgcgggcttcacagtgctgggactgacctattcccccatccggggcccggaggggaacatcgagtacctgggatatctggaaaagggtccccggcaggagcgtacatttgatttgaaggccctggtggacgagtctcaccagaccctgaaggagcacggagagggaggcaacccatgaaaaagatcatcctctgccccaaccccaaccgggaccggggcatggagaccacccgcagggcagacgccattctgcggcagatgggcttccagacggtggtgtgtccccccttcaaggaccagaaggacggggcctatggggactacaagacccggcccctgacggcggagctgaaaagcgccgacctgctgattaccttcggcggggacggcaccatcctgcatctcgccaagctggtggccctgaacaagattccggtgctgggcatcaacatggggggcctgggcttcatcgcggagctggaggccggggagctggaggccctgcggaagctgaaggactgggacttccagacggaacagcggatgatgctggacgtgaccgtccagcgggagggccgccagatctacacgaatctgggcctgaacgacgcggtgatccgggagggtcccatctcccatgtgatccatctgaagatctcctccgacgggcggcacctggcggatatcgccggagacggcgtcatcgtggccacgcccaccgggtccacggcctactccctgtccgccggggggccggtggtggagccggtggcccagaccatggtggtctgtcccatctgcacccacaacatgcgcttttcgtcctatgtcctctcgccggagcacacgctgaccatcgagctggagcgcaacggccgcaagccggtgtatctgttcgtggacgagagccgggccttctccctgaaggccgacgacaagatccaggtccgccggtccaagcacaccgtgcggctggtgcggctgtcggagcggagcttctgtgagatctttgcacaaaaaatgctgccaggaggatttgaagatgaaaaatgaccggcagagcatgatcctggagatcatcagccaggagaatatcgagacccaggagcagctgctcgtccgtctccaggagcgggggatcaccagcacccaggccaccatctcccgggacatcaagcagatgcacctcatcaaggagccggtgggccatggagtgtacaagtacgccgtgtccggcaaccggacccggctgaacttcgcggagaagctgcggaccatcttccgggagagcatcaccagcatcgacagcgcacagaacatcgtggtcatcaagaccatgccgggcctggccagcgccgcctgcgccgcgctggacgacatgggcgtcgcctacatggtggggtccctggcgggagacgacacggcctttctggtgatgcgggacacggagtccgcggccagcttctgcgaggagatcaaggagatgctgtgaggcatccccggcgggagccggttcctcccgtccaacgggatgcgccctacaaaatatggaacagattcgatattaaggagatcactggatgttcaaagtgctgaaaaccgagggccgcgcccggcgcggcgaattctcctgcgcccacggcggcgtggtccagacgccggtgttcatgaacgtaggcacacagggggccatcaagggcggcgtctccgcccatgatctgaaggaggtgggctgccagatcgagctcagcaacacctaccacctgcacctgcggccgggcgaccatatcgtccggcagatgggggggctccacaagttcatggactgggacggccccatcctgacggactccggcgggttccaggtgttctccctggcctctttgcggaagatccgggaggagggggtcaccttcgcctcccacatcgacgggcacaggatcttcatggggccggaggagtccatgcagatccagtccaacctgggcagcgacatcgccatggcctttgacgagtgcgtggagaaccccgcgacctacgaatacgccaaggccagctgtgagcgcaccgcccgctggctggagcggtgcaaggccgagcacgaccgcctcaacgccctgccggacacggtgaacccggggcagatgctcttcggcatcaaccagggcgccacgtttgcggacctgcgggtgtggcacatggaccagatcgccaagatcgactgcgacggctacgccatcggggggctcgcggtgggggagcccgcggaggtgatgtacgagatcatcgacgcggtggagccccacatgcccaaagacaagccccggtacctcatgggcgtgggcactcccagcaacatcatcgagggcgtggcccggggcgtggacttcttcgactgcgtgatgccctcccgcaacggccgccatggcaagctcttcacctgggagggcacggtgaacatcctcaacgagaagtacgccaccgacccccggcccatcagcgagagctgcggctgccccgcctgccgccacttctcccgggcgtacatccggcacctgttcaaggcggatgaggtgctggccctgcggctggcggtgctgcacaacctgtacttctacaatgagctggccgcccgcatccgccgggccctggacgaagggacgttcgcggattttcgggcccgttacagcggaaatttggaaaaacgcgcatgacccccttgcaaaagctggtatatctgctataatattgtcattctgactttggaacgaaaaggagttttgttgttatggaaggcgcttcctcctctatcatcatgctggttgttctcattgcggtgttctacttcatgctgatccgcccggagaacaagcggaagaaaaaggcccaggagatgcgggacagcctgaagaagggtgacaccatcaccaccatcggcggcatcgtgggcaagatcgtcatggtcaagccggacaccatcgtcatcgagaccagcgacgaccgggttcgtatggagctgaccaagtgggccgtctccaccaccggcgtccagtcctccggcgaggagaagtcctccaaggaggagaagaaagaggacgaggtcaagaagaccgaggagatccccgaggctcccgccgaggagaccgatgcatcctctgaagaggaaaagaaggactaacccatcataaaaccaccctcccttgtcataagctcggatagagcgatgacaggggaggaatttttatgggtaacgggcggaaacagacagccctgtggctggtgttcgtagagggcgcggcgctgtctctggggatctatctgctgctgacggtgctgctgtccgcgctggtggtgaaggcggtgctgccggaggaggggagctttcccgctgtggcggcgtcgtgctgtctggcgtccttcgccggggccatgctcagtgtccgccgctcctcctggggcagcctggccagcgccatggtgagcgccgcaggctttctgctggcggtggtggctgtggcgctgctgtgctggcagcagatcacctggctgggccgcgggggcgtgctgctgctgtgcggcgcaggcgggggacttctggcgggcctgttgggtggccggcggaggaagcggaagcgccgtccggtccgcaggggccgcaaggcctgaaaagccgcttgtgaatttcaccaaaaatacagatctgagccctgccgcggagactgcggccacaggcgggaggtctcccgcggcaggggagacggcggcggcaaatgtggggcgccgccgcttttatgtctacaagatattgtcgtttttcggggcgggggaggtgatctctcacgccgattttacaaagttaacataatattgtttacataatattttgccataactcacaaaaaacggaaaattcccgtaaattccttgcaaaatccggcgaattcaactatattagaacaagcaaggtcttacgtcaaccgctacataaatccgcctgcccccgcataggatgcggtgaggtgaggcggattgaacacgagaacattgacgaagcggcccacggtccagctgcccacgctgccccgcctgcttctgctggcgctgttcttcctggccggcgtccttttgggacaggtcctgtcgggccgggtgccggacaccacgggggacgagctgcggcggtatctggaggactacgtccgcctggggggcgagggagcgcccactgtccagacggctctgtcggccctggtgatctatttccgctatccgctgtttgcatttctgctggggttcgcctccatcggggtggtgctgctgccctgtgtgacggcggcttacggcttttttctgtccttttccgtgtgctgcttcacggcggccttcggcgtggacggcgtgctgctggccctggcggtgttcggcctgcggtgcatggtgaccctgccctgctatttcctgctggcggcggcctcctgggggacgtccgcgggactggcggccgtgtcctttgggagaggacggcggactgcccctgtggtctacggccgggcctgctgggtccggttcggcgcctgctgtctggcgctgctggcgggtgtgtgtgcggagctgtttttgtccccggtgctgctgcggctgatgctggagcgcatcctggggtagagagaaagagagagggaggagagcacccttggcaagagacgacattgcggactttgggacttatctggcggaggagcgtcacgcctcccagaacaccatctgctcctatctgcgggacgtgacccagttctccgcgtatttgcgggagcaccagagctgcacgctgcggcaggccggcggagagatgattcaggactacatgagctggatgcgggggcgggggaagtccgccgcctcggtgacccggttcctggcctccgtcaagtcgttttacaactttctgctctccgccggcgccgtaaaggccaaccccgccaagagcatcagcgcggaccgggcagagcggaagtatccggagatcctcaccagcaaagaggtggagctgtttctggagcagccccggtgcgtggacgccaagggataccgggaccatgccatgctggagctgctgtacgccaccggcatccgggtcagcgagctgatctccctggacctgaaggacctgaatctctccgcgggcttcatccggtgtgccagccggggcaaggagcggatcatccccctgtaccacacggccgtgaaggcgctgcaggactatgtgcgggatatccggccccagctgatcgccgacggcggcgagcaggccctgttcgtgaacatgaacggcgagcgcatgagccgccaggggttctggaagatcatcaagtactatcaggagaaggcggggatcgaaaaggacatcaccccccacaccctgcgccactcctttgccgtccacctgctggaaaacggcgcggacctgcggtccatccaggagatgctgggccatgcggacatctcctccacccagatctacacccatgtggtgaagcgccagctgaaggatgtgtatcagaaagcccatccccgggcgtaattccaaggggagcaccggcgcctcccgccgacgctccggcgggcagagcccgcctctgccgatcccctcgcctttgcacggcaaagacggcccccggccgactgcggccaggggcagaggcgtcccgtccaggcacatgccctggccgggacttttttctgcgcaaacgcacggcagaccacggaaatgcacagcggcgttctgcctgcctgtgaaaaaattttccgccgccgcaaacaaaaccggctgcctgggactcaaataggtgaagagaagagaaaggaggaccgccatggatcacgacgaattcgcccgccgggcggaggctctccgggcccggctgtaccggacggcgtacctgtacctgggcagcgaggccgacgccctggaggcggtggacgagggcgtataccaggccctgcgggctttgcggcagctgcgtcagccggacttttttgagacctggctcacccggatcgtgctgaacgcgtgccaccgggagctgcggcgccggcggcgcctggccggggaggaggctctgccggagagcgccggtccggatgcctatgacgccctgcccctgaaggaggccgtccgccgcctgccggaggaattgcgggcggtggtgatcctgcggtacttcgcaggatacacccaggcggagaccgcccgggcattgaacattccccagggcaccgcggccacccgccagcggcgggcattgcagctgctgcgcctggaactgggagaggagggagacgcatgacccgaaacgaggaatatcaggccctgctccaggagctggagaccacaccggcggccctggacggcgctgtggagcgggcgctgcgccgccggaaacgggaccgccgcctgcggctcttcggcgtcccggcggggagcctggcggcctgcttcgccgcctttgtgctgctggtgaacctgttcccgcccttcgcgcgggcctgcggctcagtgccggtgctgcgggagctggcccaggcggtggcctggtcgcccagcctctccgccgcggtggagaacgactacgtccagcccatcggccagtcccagacggtgaacggcgtcaccgccacggtggagtatgtgatcgtggaccgcaaacagctgaacatcttctacaccctggactatgccccggacctggggcccatgtgggcggactgccggatcacccccggcgacggcagcgcgggagacgccggcggccggacggagaagccgggggagctggtggagatcaagcgggactttgtggaccgggacgtgcccggaatcctggatctgaccctgtcggtctacccggcagagcaggacgggggcgggccgcctgcggagaacaccggcgacggctactttgaccagccggtcgatgaccagccggcgtatctggcggagatgacgttccacctggaattcgacccctatttcaccgcccaggggacgctactggagctgaaccggacctttgccctggacggccagaccttcacgctgcaagaggcggaaatctaccccacccatctgcggctgaccctgacggcggacccggacaacaccgcctggctggcgggcctggacctgtacctggagaacgagcacggcgagcggtttgaaaagagcctgggcggcatcaccgcatccggggacccggagggggagggcatgggcaccttctggctggacagccccttcttcagccagggggagcacctgaccctccacatcaccggcgtccggtggaaggacaaggacgcgccgccggtgaagctgaatctggcggagggcaccgccgaaaacctgccggagggcacctggttccagggcgcagagcgcctgccggagggatggatcgtgtacctggtgtccccgctgatggagaaccggaccatggggagcgtgttctccagaggggcctgggacgaggacgggaactattatgagatctggcagttcggctcctcctacggctactgggacgagacggcgcaggagcgcgtaggggaggaccggtggtataccgaggacttccccctggcgggactggcgggcgacacggcctatctggacccctgctacaaccggatggccgccgttgatgcggcggttcccatccaataggcgagggggagtcaaatcccccgccttccatgcgaacgagagagcgcccgccgcaaggcgggtgcttttttgcccgccgaacggcggccggggtgatcctgccggggagaagcccgcgcgttttccctgttgcgcttccctggaaaatttgttatactgttacagtatgtatactggagggaaagcgccatgcggatcctgggcatcgaccccggctacgccaccatcggcttcggcctcatcacggcggagcgggcacaagtgaacatgcttacctacggcgccatcaccaccccggcggggctgccgctctcccggcggctgtaccagatcggcaccgatatggaggacctgatcggccagctgaagccggatgtcatctccatcgaggagctgttcttcaacacgaacctgaccaccggcatcgccgtggcccacgcccgcggcgtgctgctgtacacggcggaaaagtgcgggatcccgctccacgagtacaccccctcccaggtgaagatggcggtggtgggctacggcaaggcggaaaagcgccaggtgatggacatgacccgccgcctgctgcacctgaaagccgtcccccggcccgacgacgccgcggacgccctggccctggccctgtgccatgcccggagtgccacgtcccgcctgcccctgcaggacagcagggtcaaggagaccatctgaacagtcaggaaccggaccgctccgccggacgccggaattccgaactcccaaggaagtgtgattatccatgttttactatctggacggcaccgtggcagagattctgccctatctggcggtcatcgactgcggcggcgtgggctacgcctgcaagaccaccaacaccactctggcccagctgaaaaagggccagcgggggaagctctacacctatctggacgtgggggagaacgccttcggcctgtacggcttcgccacggccaacgagctgaacagcttcaagctgctgatcggcgtcagcggcgtggggcccaaggcggcgctggccatcctctccgccgccacgccggagtccctggccatggccatcgtcaccggggacgagaagagcctgacggcggcgccgggcgtgggcaagaagatcgcccagcggatcatcctggagctgaaggacaagatggcccgggagagcgccgccacggggctggacttctccggcggagccgctgtgagcgtcccggcctttacaaataaggccacagaggcggcccaggccctggcggtgctgggctacaccagcgctgaggtggcccaagcgctgaagggcgtggacgtggaaactctgtctctggaggagatcatccgccagtgcctgaaaaagatggtgaagtgagtatgaagatcctgtccgtgattctgctcctggccgcgctggccatggcctttcttgccatgatattcggaacccgctttgcggccctgctcaataagggccagcagcgccacggcctgccggaaaaagagcggcggcagcgcaaccgcagcggcgcggtgttcgccctgtgcctgtgcgcggtgttcggcctggcctggctggcggtgcatctgttccaggcgggctgaccgccccggccggaattttggagcacattcagagcacatgaggaagtgaacccatgagcatcgactttggaaacgacatctatgaagagcccatcgtggccaagaccttcctgcaggaggacgcccaggaggggtccctccggcccaagaccctgcgggagtatatcggccaggagaaggcgaaggacaacctggccgtgttcatccaggccgcccagaagcggggagaggccctggaccacgtgctgctccacggcccgcccggcctgggcaagaccacgctggccgggatcatcgcccaggagatgggggcgggcatccgcatcacctcgggcccggccatcgagaagcccggggatctggcggcgctgctgacgaacctcaacgagggggacatcctctttgtggacgagatccaccggctgaaccggtccgtggaggagatcctgtacccggccatggaggactacgccctggacatcatcgtgggcaagggccccagcgccaactccatccggctggacctgcccaggttcaccctgatcggcgccaccacccgggcggggcagctgtccgcgcccctgcgggaccggttcggcgtgacgctgcggctggagctgtacacgccggaggagctctctcagatcatcacccggtccgccgccattttgaacgtggacatcgtgccggagggcgcctatgagatcgcccgccgcagccggggcacgccccggatcgccaaccggatgctgcgccgggtccgggacttcgcccaggtgaaggccgacggcgtcatcaccaaggatgtggcggaccaggccctgtgcgcgctggagatcgaccacctggggctggaccccatcgaccggcggatgctgggggccgtcatcgagaactacggcggcggtcccgtgggcctggagaccctggccgccaccatcggcgaggaggccgtgactctggaggacgtgtacgagccatacctgatgcagctgggcttcctgacccggacgccccggggccggtgcgtgacggcgaaggcataccagcacctgcataagcccatccctggcggcatgacggcggatccgccggacatggaccagctgacgctgtgaggaggcggttttcatgaagcggaccctggcggagcgcgtcgcatttctgatgctgtcggcggcgctggccgtcggagcctgggccgtcacaggccgggctgcctgctccgtgacggcgccctatcagtttcccgtccagcccggcacgccggagtgggtggagctgtccgccaacgcccgtcgtgccgcctgccgcctgccggcggggctggcagagcagatgacctccgaggccctgctggagacggcgctggactatccgttcaacgcctccatgtatgtgtccagcgacctggaggggatgttcggaaagcgggcggccctggcgggcaacgacgccctggcggagctggtgacccggccggacgcggaggaagtgatcgcccgcgcgctggcggcgcctgcggaggcaggggaggaccccctgcggggcgtgtatctggagaccttctgcgcctggctgccggagctgtccaggatggcgggcgtctgaggcgtcacaggggcaggccccggccggtgcgcaggcccagcagaaaggcatggatggcggtgaattcccgggccttttcgtaatccgccgccatctcagaggtgagctctccctccagaagggagaggggcatctcgtagtcatccggtggggcagcgtccagctgggggcggatgtagtgggcgtacagccatttcatgaagtcggacattgcgaatgctcctttcaaaatacaatggatgcgttgtgcttagctgcagtataatacaacggatacatcgtgtcaagaggtgacgatatgacattgcaagagcgaatgcgggaactccgcaaagagcggaaggagacccagagacaggtggccgacgccatcggtgtgacggatcggcagtaccagcggtttgagaccggggtcaatctgcctggatttgaaaatctcgtgggcattgcggaccacttcggcgtatcgctggattatctggccggccggtcggaccggagggaaatgtagaggcgggtttcccgccgttcagaggaacctgctcctgcagggggcgtacagcctttttacaaagccggacattgcgaatgctcctttctgcaaacaacttttaagctgtttgcagaaaggatatatcacgacttttaggttgtgccaaggagatcatatatggagttttatgagcgaatgcgggaactccgcaaagagcacggcgagacccaagcgcaggtggccgcagccgccggaatgacagaccggcagtatcagcggtttgaaacaggcaaacaaaagccggggtttgacagtctgcttgccctggcggaccacttcggcgtgtcgctggattatctggccgggcggtcggaccggagggagatgtagaggtgggtttcccgccgttcagaggaacccgctcctgcaggggcgtgcggcccgtttttggagtcagacattgcgaatactcctttctcacgcttcataaagcgtgagaaaaatataacacgctctgcgaagcgtgttaagggggatttatggaactaaacgagcgattgcgggaactccgcaaggaacagggcgaaacccaaaagcaggtggccgccgccatcgggattggggagcggccctaccaatacttggagtccggcgagcaccggcccagcctggacacgttgatcgccctggcggaccacttcggcgtgtcgctggattatctggccggccggtcggaccggcgggagttgtaaaaggccgccgtccggcggcctcgggaatctttgctcccgcaaggggcttgttcagcgggatgcaccccccattttcttttcggtcttgcccgaaaagaaaacgggccgtgcacggtccaaaagaaaagaacgcttttggccgcaactctgcacgggcgtgcaaagttgctgtacgggggttggcgtgagatggtgcctgcgtgtttgcgaggactggccaacgggcgcggcggggtgcggtacaggcttgaacgctgattcccgcggcgtggatgcggaggtcaacggggtgcaaggacgcatttgaccagctcctctttctgcgcgttccgcttcgctacgcgctgccctggcggtcgtaggggccgatgcctttatcggcagctcccgcgcgggacagctagcggcagcgaaaagagaagcagctccatgcgatgaccaccccgacgacctccgcacgatccgccacgggacggcagttggagaaatcgcagaagagtatagcgtgcccgaaggccgggccaaatcggcgcttgcaccgatccgccgccccccgtcgcgcggagggccactgcaccggagcgcgccaacgcttttctctttggaccgtgcacggcccgtttctcttttggcacgacaaaagagaaacggggggtgcatccgcccagccatcaacatagctgaatccccgtcccatggggacggtcacatcataagaaacaaacgaggtaatatcaatgggcaaactatttggaaccgacggcatccgcggcgtggtgggggagaacctcactgccgacatggccttccgcgtggggcaggccgtgggcactgttctgatggaggacaagggcagccgccccaccgtggtgatcggcaaggacacccgcatctcctccgacatgctggagtccgccctgatggcggggctctgctccgtgggcagcgacgtaaagccggtgggcaccattcccaccccggcggtggcctatctcaccgtgcaggaaaaggcggacgcgggcatcgtgatctccgccagtcacaacccctatgagcacaacggcatcaaggtcttcagcggacagggctacaagctctccgacagcgtggaggcccggatcgaggagaagatcctctcccaggagcccatgaagctccgaacccggggggagatcggccgccgccaccacggtatgcgccagctgaagcgggactatatcgacttcgtggcctccaccatcgagtccgatctggcggggctgaaaatcctggcggactgcgccaacggcgctgccagcgccaccgcgccggagctgttcggccgcttcaaggcccggacggacttcatccaccgggacccggacggggtgaacatcaacagccactgcggctccacccacctggaggacctggccgccgccgtggtgcggggcggctatgacatcggcgtggcctttgacggggacgcggaccgctgcctgctggtggacgagaccggcggcgtcatcgacggcgacaaggtcctggcggtgtgcgccctggacatgaagcgccggggaaagctcaacggcaacgccctggtggccacggtgatgagcaacctgggcctccacgagttctgccggaacaacggcatcgacctgctctgcacggatgtgggcgaccggaacgtgctggagaagatgctggagcgggactaccgcatcggcggggagcagtccggccacaccatcttcaccgatgtggagaccaccggcgatggtgaagtgacggccctccagttcctgcaggtgctggcccggtccggggagaaagcaagttcccttgtcagctgctgcgccgtctacccccaggttctggtgaacgtggaggtgccccacagcggcggcgtgaaggaggccattatggcgtcccccgcgctggcggaggccgtgaagcgggaggaggaggccctcgccggcgctggccgggtgctggtgcgcccctccggcacggaggccctgatccgggtgatggtggaggccaaaaccacgcagatcgcccaggcggtggcggaccggctggcagatttcatcaaatcgcaaaaaaaataaaaatctgtttctcggatttttttacaaattgcttgacatttcactggatagacaggtataatacgatatgtacaaatttagcgagaagacaccccagcccctggaccagtgcagcgatgaaacgctgtgccaactggttgccggcggcagccgcgaagcggaggaagctcttgtgacgcggtacaaccggctggtccggacctgcgcccgccccttctttctggtgggcggcgacagcgaggatctgacccaggagggcatggtgggcctcctcaaagccgttcgggagtatgacgcctccaaggaggcatccttccggaccttcgcagaaatctgcattcgtaaccggctgtattccgtcctccgcgccgcggcgcgggataagcacatggctctcaatcagtcggtccccttggatacacccttctttgacgccaattcctacacctctggtaccagcgatctgactcagcgcgatcccgaagcgtatctcatcgacagggaacataccgctgccctcttatccggtgtccggaaacagttgtccgagtttgaagcaaagattttggggtactatttagacggtctttcatgcagggaaattgccgagacggtaggcaagcccccaaagtccgtggacaacgccgtgcagcgcattcggcgcaaggtggcacggcagcttctttccggcgatctcagcggaagctgaacgcaatatatttttcttttcaaagagagggtaacatcatgtacgaagacaagaccttagtttgcaaggagtgcggccaggagttcgtgttcaccgccggcgagcaggagttctatgccgagcgcggcttccagaacgagccccagcggtgcaaggcctgccgtgacgcccgcaagaacgcggcccgcggtccccgggagtatttcaccgctgtctgcgccgcctgcggcggcgaagcccgcgtgcccttcgagccgaagtctgaccgtcccgtgtactgcagcgagtgcttcgccaagatgcgggaccagcagagataaacgaatcaatccgttttggtctcttgcagaggcggcgcccggtgggcgccgcttcttcttttgccgtgggagccggccgccgcgccccgcgccggggaaacgggaggcattccggaaaaatgtgccggtgcggacgccgaatctccacatttccaggcttttcaaagattttctcttgaaaaacatcgaaaactagagtataatacccctgctgaatttcagattagaattggaggaacctctgatgatcgagatcaagaaggacaccatcatcggtgacattctggacgtggcgcctcagaccgcgcccatcttcctgtccatcggcatgcactgcctgggctgcccctcttcccggggcgagactgtggaggaggcctgcatggtccacggcgtggactgcgacaagctgctggccctggtgaacgaggaagccaacaagaaagcggaatgaccggaacgggacgcatacgggagaccgtatgcgtcctcctccgacagccggaacaggagggcgccatgggaaaacatctggaactgacgccgcgcctgcggcagatcgccgcctgggtccgccagggtgcgcacctcgctgatgttggcacggatcacgcctatctgcccgtgtggctgacgctgcagggccgcgtggcctctgccattgccagcgatctgcggcgcggccccctggaccgggcgcaggagaccggccggcgctacggtgtgggggaccggatcaccttccgcctgggcaacggtctggccgccgtggcgccggaggagtgcgacaccatcgtcatcgccggcatgggggcgagaacatcgcccagattctggccggggcaccctggaccgccgacggccgccacaccctgctgctccagccccagagccgggcggaggcgctgcgccgcttcctggcggagcacggctacgccatagcgcgggaggcgctggtgcgggaccggggctttctctatcccgtgatcgaggccggggcaggggagatgcatctcacgctgggccggcagtgggccggggcggacctgctctacgacccctgggggaccgctacatcatcgagaagatcatccagctccaggcggcggcggccgggtccaaccgggcgtcggcgccagaggcccgggaacggggcgattacgccagggccgtcatcacggagcttctgcaaatgagggaggagtggcgccatgccaactgtccgggaaattgaacaggccctgttccgactggccccgaaggagggcgccatggactgggacaacgtgggccagctgctgggggacccggaggcggaggtccggcgggtcctggtggccctggacatcacggaggccgtggcggacgaggccatcgcggaaaactgccagctgattgtcagccaccatccggtgatgaactgcaaatggctgccggtgcagaccgtccggcaggacacgccccaggggcacctgctgctgaaaatcctgaggagcggcctgtccgccatctgtatgcacacgaacctggatgtggcccccggcggcgtcaacgacgcgctggccgccgcgctggggctggaggaccctgggccgctggggacccggaggggctgtgccggatgggaacactggcaagtcctatgcctttacaggaatttgcaaagcacgtctgccgggcgctccaggccaacggcgtccgctacgccggggacagcggcccggtgcggaaggtcgcggtgggcggcggcgcctgcggcgactatgaggatgcggccatcgccgcagggtgcgacgtgttcgtgacctcggacctcagctaccaccagtttttagacgcggcagggaagggcatccgcctgatcgacgcgggccacttccccacagagaatccggtgtgcaccgtgctggcagagtacctgcgcggccggttcccgggcctcaccgtcaccaaatccgcctcccaccgggaggtcatccagtattacgtagaaggagagtaatgtaccatgtccggacattccaaatggcataatatccaaaagaccaagggcgcggccgacgccaagcgctccgccgccttcaccaagatcgccaaggagatcatcgtggccgtgaaagagggcggcggctccggcgaccccaacaacaactcccgcctggccacggtcatcgccaaggccaaggccgtcaacatgcccaacgacaacatcaagcgcaccatcgaccgggccctgggctccggcagcaccgacaactacgaggccgtcacctacgagggctacggccccggcggcgtggccgtcattgtggaggccctgaccgacaaccgccagcgcaccgcgccggaggtccgccacgcgttcgacaagtgcaacggcaacctgggcgcccagggctgcgtcagctggtcctttgacaagaagggcgtcatcgtcattgacaacgaggagggcgagctggacgaggacaccgtcatgatggacgctctggaggccggtgccgccgactttgaggccgacggtcccgccctggagatcacctgcgaccccgacgctttcaacgatgtggtgaaggccctggagggaagggctacgccttcgccagcgcggagatcgagatggtgccccagaactacatcaccctcaccggcgagggagacgtgaagaacatggagaagctcatcgacatgctggaggacaacgacgacgtgcagaacgtctggcacaactgggataacgactgagcatcgctggatagagagaggacggggagacccgtcctcttttcatctctgcagaaatgaaacaaaacttttcttttgtgcaaaaacgccggagaggcgggcctaaccggtcccccttaccattaccataacaatgaccataaccatcaccataaccctaactctagctattaccataacgggagaattttacaaaatcctcccggagattgcatagaaccgtgcatcagatggggaggggacgccttttcttgagaggagtggtttttcgttggcagaggaacacaagaagagttttatgctgtatttcgataattttccctgtgtggcggccctggacgcggagcagcgggggaactgctgcttctgttgtaccgctatgccatggcggcggacaaggctcccacggatccggaggaggttttgcggcagcacccgggcttgagggaggagacccgcatggcctaccggtttctggcggagaccattcggcgggatacagagaagtggaaggaaaagcagcggcgctaccaagaggcggcggcgcggcggcagggggatggggcgatctcccggcaggccctggaacaggccgcgcccaaggattacagcgacatccggaagtacctacgggacgtctctaccgctggtcggttgccaaaatcggacccatagggtagactgagggcgaggtgatacacgtgaacaaggagcggctgggcgatttcatcggcagcgagcggaaaaatctgggcctgacccagcgggatctggcggcgcggctgcatgtgacggacaaggccgtcagcaagtgggagcggggactgagctacccggatgtgacgctgctggagcccctggcggcagccctggacttgacggtggaggagctgatggcctgccggaggcaggcggcgaaaggagcggaggagaccatgcagagcttgttggatatctcccgtgacagcgtgcggcaggagcggcggcgctcctggcagcggctggcggcggtgctggtgctgctggccgtaactgcagccgtggtggcgtatacgcagatcgtggtgacggaggaggggtattacagcatcgttctgaaagagactgtgaatggcaggaactgtgtctatgtggaggaccgtggacacctgatccggctgaagtgcggggaggatgtggactttgatgccctcacgctgcgggacgagcggggagataccatttcctatcagatggactttcaatggaaccggctgacccgcactggtacggtgtctgcctgtgaggacaccggcgtcaccgttctgggaggtgtcatggatgtcacctatgagggggattccggcagcgtgccgcttctcttcggcgataccagcgtccagtatctccgggacgggtattacccggacccctacgcagagtccgaaaatctggtgtttttatgtgacgtccggttttggccctatcatccggaggagccggaccccaccggcatcaacacccgggcaatcctggaagtggaggactgcatcaacgccgaggcgctggacgtggatggggacggagcgctggaggtggccgtccgcacccgctggccggagaagccgtacaccgtctacgactatgtggatggagagattgtggagtcatggccggacaccctgccggaggagattttggaacagatgtgggccccgtgggaagggctatgagaggtgctgcctatggaatctcctgcgccccccctctgagagcggcgggtggggtctccttccacccggaggcggggagccagcatctggcctttcacagccgggagcgggtcctccgccgcatcgaccagtacaccgcgcggcagtaccggcatcaatcgggacaaaaagaggccctggctttcgccaggacctcttcttgtacgagcaagactgtaagccgggttctgtatcaaacagtcatctatctcgacgtaccgtcgccggtacgctccagccaccccgggagcggccgggccagccttgagggtcggaccccctgctcccataccggtgttgctccggatagagtttacagcatcggacagtctccagccgatgggtgagctcttacctcgcctttccacccttaccgacagagctactctctgtcggtaagggtggcttgccgctccccgcgggagcggccgctgcggcgggctgattgcaattaggaagagggacccttcgtccctcttcacacaacacccctgcgccgttccgcgcggaagcgattgcgctgttcggggaagtttccctcgccccgctccgcgggcatcgcgttcagccgtcgctggttccctgaccgatacagagtaactctgtcggcggtatatctctgttgcacttttcctgaagtcgccttcggcgggcgttacccgttatccttgccctgtggagcccggactttcctcacgaccggcctttcggcctggccgcgcgactgtctgtcttactcgcctgtctattttagcggaatccgacgggattgtcaacgcctggccgcaatgcggcctccacatcggcggaagtcgccagggccttccgctgaaaataccggatggcccgcagagcgcagttaggtcccggcttcatggccccgcagccctgggagaaaaagtctgggaaggggaggggcgtggttgtatttttttccgatctgcggtataatttccttgtctgtcaatctctgccgcccagcgcggcgttaggagcgtacccatgaagtttgaggaatatctggactctctgcggaacaagtccgtggccgtcatcggcatcggcgtcagcaaccggcccctgatccggctgctgctggagcggggcattcgcgtcaccgcctgcgacaaaaaatcccgggaggccctggggcccctggggacgagctggagcagcacggctgccgcctgcagctgggggaggactacctgaagggcctgacggaggacgtgatcttccggacccccggcctgcggcccgacgtgccggagctggcggcggcggtggcgcggggcagcctgctgacttccgagatggaggtcttttttgaggtctgcccctgtcccgagatcgccgtcaccgggtccgacggcaagaccacgaccaccacgatcatcgcaaagctcctggaggccgccgggcgcaccgtccacctggggggcaacatcggccgcccgctgctgtgcgacacgccggacatcgcgccaacggatctggcggtgctggagctcagctccttccagctgatgaccatggaccggagcccccgcatcgccgttatgaccaacctgtctcccaaccacctggatgtccacaagagctacggagagtatatcgctgccaaggaaaatatctttacacaccagacagtccgggatattgccgtctttaatgccgacaacgaggccacggtccgctgcgctgaaaaggccccgggccgggtgcggtggttctcccgccggaaggaggtggcggacggcgtgttcctccggggtacctctatcgtctgccgggggccgcagggcgagcgggtagtgctggacaccgccgacatcaagctccccggcgtccacaacatcgagaactacatggccgccgtcgccgccgtggacgggatggtcccagacgaggccatccgggccttcgcccgcaccttcggcggcgtggagcaccggatcgagctggtccgggagctggacggggtgcgctggtacaacgactccatcgcctccagccccagccgcaccatcgccgggctccggtccttcccggagaaggtcatcctcatcgccgggggcaaggacaagggcatctcctatgacgccatcggcccggagatcaacgagcatgtgaaagccctgatcctctgcggcgcaaccgccggggtgatccgggccgccgtggagaaggccgccaacttcaccggcctgcccatcacggaggtggacagctaccagtccgccgtggcgctggcccgtgagacggcgcggccgggggatgtggtgctgctgtccccggccagcacctcctttgaccggttcgccaacttcatggagcggggccgggtcttcaaggatctggtgaacgctctgaaataaggccaggccgcccccgcatacaatggcgggaagggggcgtgatggccatgatctggcgcggattttacttctaccgccggcggatggaccgccggcgggtgctgcgggccctggcgtttctgctgatggctctggcgctgacggtgctcttcatcgccgccacccagatgcggcctctgctggagagcatggccaccacccgggtgtccaacaccgttacccgcatcgtcagcgaggccgtgtatgaggccatcgagaagggcgagctgcagtacgacggcctggtgtcctttgagaaggacacggagggccacatcaccgctgtgcagagcaacatggcggccttcaaccacctgcaggcggagattctggacacggtcctgacccgcatcagccaggtgcccaccggggacctgtccatccccatcggcagcctgacgggttcgacgctgctggcgggacgggggccccgcatcaccgtgcggatggagtccgtggggtcgtcggaggcgaacttccgcaacgccttcacctccgccggcatcaaccagaccaagcatcagatcatcctgacggtggatgtctccgtcagcgttctgctgccggggttccgcaccgccaccaaggtgtccaattccttcatcgtggcggagacggtgatcgtaggcacggtgccggacacctacacttatttctccacagatccggatacgtacgaggaggatctgaaagactacattctgaacaacagctgagaagggagcacaccctatggactaccgcgaggaaatgaagcagctgcgggactttttgaaccagcagagctatctgtactatgttctggacgcgccggtgatcccggattacgagtacgaccggctgaaccggcgcctggaggagctggaggctgagcaccccgaggagatcaccccggactctcccacgcagcgggtgggagacaaaatcctggagggctttgagacctatgagcatccggtgccgctggagagcctgcaggacgtgttcaacgcagaggaggtctcggagttcctggatcggatgcgggaggccctgggggacggcgccgcctactccgtggagcccaaggtggacggcctgtccgtggccctggagtatcgggacggcgtgttcgtccggggcgccacccggggcgacggccgggtgggggaggacgtgacggagaacctcaagaccatccgcgccatccccatgcagctgccggagaagctgccccggctcatcgtccggggcgaggtctatatgtcccgggcggtgttcgcggagatcaatgcccgccgggagctggagggcaagcccctcatggccaatccccggaacgccgccgccgggtccctgcggcagctggaccccaagatctgcgcggagcggaagttggatatccaggtgttcaacctccagctggcggagggcaagaccttccagaaccactcggagaccctggactacatggcctcccagcacttcaaggtgatcccccacaagaccctctccgacccggcggagattcaggcggagatcgaccggatcaacgaggagcggatggactaccccttcgacatcgacggggcggtcatcaagagcgaccacctggcggaccgggagcggctgggctccaccgccaagttccccaagtgggcggtggccttcaagtacccgccggagaagaagttctccgtggtccaggacatcgtggtgcaggtgggccgcaccggcgtgctgacgcccaaggcggtgctgtccccggtgcggctggcgggcaccaccgtcaccaacgccaccctccacaaccaggacttcatcaccgagaaggacatccgcgtgggggacactgtgctggtgcagaaggcgggggagatcatcccggagattttgagcgtggacttcgacaaacgcccggagggcacggtgccctacacgctgccggacgcctgcccggtgtgcggcgccccagtggtccgggacgaggacggcgcggccctgcgctgcaccggcgcggagtgcccggcccagctgctgcggaacctcacccacttcgccagccgggacgccatggacatcgacggctgcggtccggcggtgatccagcagctgatcgactccgggctgatctccaacgccgcggacctgtacagcctccacgccgcggacgtggccaagctggaccggatgggggagaagtccgcggagaacctgatccgggccattgagaactccaaggccaacgacctgagccgcctgctgtacggcctgggcatccggcaggtgggggagaaggccgccaagaccctcgccgcccacttcggctccatggacgcgctgatggccgccacagaggaggcgctgacggagattcccgacgtgggcggcatcaccgcccggtgcatcgcggactacttccggggcgaccaggcgaaggacctgatccgccgcctgaaagaggcgggggtgaacatggagagcaccgcccagcccaccggggacctgctggcgggattgaccttcgtcctgaccggcgagctggagtccgcctcccgcaaggaggccggggagaagctggaggctttgggggccaaggtgtccgggtccgtgtccaaaaagaccggcgccgtggtggccggagaggccgcgggcagcaaactccggaaggcccaggagctgggggtgccggttctcagcgaggagcagtaccgggtgctggtggacgaggtccccggcgacaaggcggaaatcctggccctgctgggccgggacgaggcggcaaaagaagcggaataaacagggaagcgggggctcacgcccccgctctttcggcttgtgtgcaggctgcgctgcgatgcgtgcccggcgggcgtaccgtcagcaggggtcatcgatctggatcatgaattttgtgacgtattcctccgggctggagatcgcaaattcgttcaatccaagctcgtaggcaaagcccgtcagtgtcagatgctgccggcgggcatagtcgatcattttttggtacatggcgggcgccttgtcccaaggtcccttctgatagccgcaaagataccgccccgccggcctgacgaacgtatgcggaccggatgcgctgccggacgaataggtaaacagcccgtcgtatgtttcaaaggacccggcggtgactttgtccagggagaggaagctcccgattcccatgcgtatctgctcaatgccccattgacttttcaaatcggtaaaaagccgggataaatcgtctccggaaaaatcatacggcaaaacagaaattttgaccgcgccgcactcctcgaccctgatttcctcatccggcaggccctcgcaaagacgcacctgcgcttttttggtcttcagtatgttccgcgcgcgcttcagccttcgtatctccagatcgatttccgcctctttccgatctgcgatctgcaaaaacttttccggagcaggatgcttacagtagtccgcaatttccgcgatgctcatattcaactctttcagcatacggatatactcaaaaacaatgctctgtgatgcgtcgtaatagcggtaaccgttttcccccttttggcagggggaaaacaggccgatgtcgtcataataatgcagcgttctccgattgacaccgtgcagttccgcaaactgggcggtggtcatttttacagtgttttgcctcatcacaaaatagctccttttccggtattgacattacagctgctgtaaggactattatacggggtatccgagaccaataccagggggaatatcatggagatgcaaatcagagaatatcagaaacaggactttcagcccttaaaggaaatcatccgaagcacgtggcactatgatgagttcagcagtcccgaaacggcttccaggctggcggaggtttttctgcgcagctgcctgacaaattacaccttttcacaggtggccgtacttgacggaactgcggcagggatcattttggtaaagaacaacaaggatcacagatgcgccctctctgccagatttcagcaaatcctgtccattgtgaagctgtatgcgtccaaagagggaagggcagtctctcaaatcttccaaaacgtcaatgagatcgatgagcaattgctgcgcggctgcaaaaagacctatccggcggaattggctctgtttgctgtccgttcatcctgtcagggaaagggcatcggcaaaaagctgtttcattccgcgcttgcctatttgaaacagcagggattggatgaattctacctgtttacagataccagctgcaactacggcttttatgaacaccagggcatgtgccgccgcggccagagagagcatcttttccagataaacgggcagaccgtaagcatgaatttctttctttatgaccgcgcaacggtatttcatgacgctgcgggctgcaatttttgaaattgtattaactgcataaaaaataattgtttttttgtgcagttcatcaatattctggagcgagtcactccgaaacattatccagttcggccatagacaccggcggctctgcgtggtatctttgttaagcaccagccgggaaggctgggagtctgatacagaaaggatgtgtttcccatgcgactgcgttccgaagcggacgtgcaggagttcctggacgccgtcagccagtgcggcggcgacgtgtacctgaagagcccggagggagacatttttaatttgaaatcctccatgtcccggtatatcgccatcggccgcctcatcgaggagcagggcgataccctggagctctttgccgaccggaaggaagaccaggcccggctcatgcccctggtggaagacctgatgaagaacggggactgagtccccgcaaaaagcgcccgccccgatctcccggggcgggcgctttccattcagtgggtcacttgtcaaaggacgggttcacaaagtagagattcttctcgttcatcttgtccttggccagccgcagtccctcgccgaagcgctggaagtggacgatctcccgggcccggaggaacttgatgacgtcgttgacgtccggatcgtcggagaggcgcaggatgttgtcgtaggtgacacgggccttctgctcggcggccagatcctccgtcaggtcggcgatcaggtcgcccttcaccgccatgctggcggcgctgtaagggaagccggaggcggcggtggggtacacgccggcggtccggtccacaaaatacgtgtcaaagcccgcggtccggatctgctcctcggtgaggtccctggtcagctggtggacgatggcgccgatcatctccaaatggcccagctcctcagtgccgatgtcggtcagcaggcccttcagctccgcatagggcatggagtaccgctgactcaggtagcgcagggacgcgcccagctcaccgtcgggcccgccgtactgggagatgatgacggaggccagcttgggattggtgttcttgatcttcaccgggtactggagcttcttctcataaatgaacatcagtcattgcctccttcctcccagggccacgggtccttcagccaggcgaagccgtcctccggcgtcaggtccgtctgcagcagggggccgtacatcttctggtacttctcacggccctctttcgccagcttgatataggaccagtacagctgcagcgcctcctgatcctgggcgtgggtggtgagatacaggcccagctcgtcaatggcaaagtccagggccatcagctccaccagggcggtgttggccattttcgtcttggcctggatggccgccttgaaaggcaggtcaagccccgggaacagggtgccggtttgcagggcctccatccggctgtaccggacagggttctcctcctgcatggctacaaagggaaacaccatgggtgcacaggtgccgggcagagtgccctggttcggctggcaggagccggacggcggcatggaaggcacggacggcgtgggcggcgtattggtgttgggtttctccatctgcatggatgcctccttctggggtagggtgcgcatgggaaccatgcgcccatgccatcctatgcggagatggtccgggaggagcctgcccttgatttccgccgtccgagccgctataatcgggaatatgggataagcaggcgggaataggctttccccagggggtgccgcctgtgattattctgatccgaaagcgccatgtggcgtatgttgtgctgctgtgttgttttgtcgccgggctctccgccgtgctgtggcatgggaacgccgccttcacggcggcgttcgccccgggggaggagggcgcgtctcccgttgtggtggtggacgccggccacggcggggaggacggcggcgctgtggccgccgacggcacggtggagagcggcctgaacctcgccatcgcccggcgggtccgggacctgctgacctttgcgggggtgcccaccaccgtcacccgggagggggacgccgccatttacgaccccggcagcgccactctgcgggagaagaaggtctccgacctccacaaccgggtggctctggtgaatgagctgcccggcgcggtgctgttgagcatccaccagaacagcctgccgtcgtcgccctccacccggggggcccaggtgttctggaaccgccaggagggggcggaggaactggcgtcgtccattcaggagtccctgaacggcgccgtcaacgccggacatgagaagaaggccgcccaggtgccgtcctcggtgtacctgatgaaggagatcaccgcccccggcgtgctggtggagtgcggatttctctccaacgccgcggagacggaacagctgaaggacccggcctaccagacaaagctggcggcggccatcgcggcgggcgtgctgaattcagataagcgttgaaagagaaaagatcagacagtttgttcctttctctttccatgggaggttgcaatgaagccaaagactctgttctactgcacggagtgcggcaatgagacgcccaagtgggcggggaagtgcccggcctgcggggcgtggaataccatcgtggagcagccccaggccgcccgggcggcagggaagggggcctcccgcccggcaggaggggggccgtccgcagggcccggccggtgacggagctggaggcggatgcggaaatccggttctccactggcatgggagagctggaccgggtcctgggcggcggtgccgtcaagggctcgctggtgctggtgggcggcgcgccgggaatcggcaagtccacgctgatgcttcagatctgcgagagcctctgccgggagaataaggtcctgtatgtatccggcgaggagtcggagcaccagctgaagctccgggccaagcggctggacgtgcagagcgaacggctgttcgtgatctccgagaccagcctgggggacctgctggagtccgtggcggcggaggcgccggacgtgctgatcgtggactccatccagaccctgtacaatgacgcgctggagtccccggcgggcagtgtcagccaggtgaaggactgcaccatggccctgatgcagctggccaaagggcaggggatcacggtgttcgtcatcggccatgtgaacaaggaggggtccatcgccggccccaaggttctggagcacatggtggactgcgtgctgtactttgagggggaccagcacaccgcctaccgcatcctgcgggcggccaagaaccgcttcggcgccaccaatgagatcggcgtcttcgagatgcgggacagcggcctcgtggaggtggagaacccgtcagagatgctgctgtccggtcggccggaggacgcccccgggacctgcgtcacctgtgtgatggagggggcaaggccggtgctggcggagattcaggcgctggcggtgtcgtctccggcgggcaacccccgccgcaccagcaacggctttgactacaaccgcttcgccatgctgctggcggtgctggagaagcggggcggcctgaaggtctccgcctgcgacgcgtacctgaacatcatcggcggcttgagcctggacgagcccgccgcggatctggcggcggtgatcgccctggcctccagctatctggaccggccggtgccggcggatttggtggccatcggggaggtgggcctcaccggagagctgcggtccgtcagccagctgggccagcgggtcagcgaggtccggcggctgggctttacccagtgcctgattccgtcccgccggaccggggagctggccgcgcctgcggggcttcgtctgatcccggtgcggaatatcggtgaggcgatccgagccgcccttcgtccgtcggaatgaagtggacgcaggcgccgcccagggcggggaggcccgccgcggcggcgctgtccagcgtgcagacgccgtcctgctgatacacacattggctggtacagggaatcaaactcatacacatcatcccatctccatggatttgggactagctttgccgaaagcggcggtttttatgtccggtccggagatgcgccgcgcattccggcgtgtgccgccggcgctgcggctgcggtccggccgggaaattttcaaaagacctgtcagggaaggaggttttgcggggagacagaaaattgaacaaaataaaaattttgttcaatttgggggagagccaaaccgctccggggcccgtttcaggcccccggcacgacctacccccccagcagccgctccggcggctgcgcggagtatctgcccgcaagttgacaccgttatggctgattaccgcaccgaagcgccgcagattctgcgggactttctctcgtaccacgagaccatcaaagcccactccaagcggaccgtggacgaatactttctggacctgcggaatttcttccgctatctcaagcagacccgggacccgtccctgtgtgaccggtctctggatgagatcgacattatggacgtggatctggacttcgtggcctccgtgaccctgacggacatttacggctacatgacgtacctcagccgggaccgggtccagcaccagaacagccggaattccggctacggcctgaacgccgcgtcccgggcccggaagatcgccacgatccggtcgttttacaactacctcaccaataagatgcacttacttcgtgaaaatcctgtcaaagatatggattctccgaaattgaagaaaaccctgcccaaatacctgaccttggacgagagcatccagctcttggactccgtggacggcaaaaatcaggagcgggattactgtatcctgacgttgttcctcaactgcgggctgcggatcagcgaactggtgggtctgaacctctccgacatccaggaggatgccctgcgggttcttggcaagggcaacaaggtccggatcatctacctgaacgacgcctgccaggacgccatcgccaaatatctggcagtgcggcggcccatcaccggccgggacgcaaacgccctcttcctctcctcccagaacgagcggatcagccgctccacggtccacgccatggtgaaaaagcggctgggtcaggcgggcatcgacccggcggagtacagctcccacaagctgcggcacaccgccgccacgctgatgctgcagaacggcgtggacgtccgggccgtccaggaggtgctgggccacgaccatttgaacaccacggaaatctacacccacatcgacaacgaatccctgcggatagctgcaaaggcaaatcccttgtcacacgtgaaaaaatcaaggaaaaagcaaaaggaaaccggctgagaggcgctccctcccagccggttttccctgttcattttgcgcaaacgattgcctaaggccggatggtgcccagtacgtgcagaaaccggatgtcctggaacgtgtaggtggacaggggccggttgtcggcgtcgtagctgtgggcggcgatcagtaccgtctccagggtgatgggcgccgtcacccgcaccaccaccggcgtatgctggaactcctggccgttgaagctcagctgcaccaggtccccgggctgcaggtcctccagggcgcagggctgggccaccggccccacggagggcgcctgcctggtcatgaaattccagaaatagggcaccccggtccaggagggggacttctggttggcgtcgatgtagtaccagccgaaatccggggtgaagttcatcacaccgctgccggcgaacacacactgagacgcgaagttggtgcagtctcccccacgttctcgtagtcgtaaaaggccgggttccggccataggcccactggtgggcatacagcacggcggcactgcggtcgtagtctgcaaaaaagcgcatgggctcccctcctcttcccgccattgtatgcgaaagagggacgtttggtcagttgggagttcggaattcatgtgttctgctgcaggcggaacaattggaatgggtccggcaaagccggacccagaaattgctcattccgcatgattcctcattcctaattcgctccgatagcgctccgcctggtccagcagctctccggcgcttgccagcagggcctctgtcacgcggctgccgccggtgatccgggccagctccgccttccgctgctcccagtccagcagcaccacacgggtataggtgcggccgtctcgctcccccttctccacggagaagtgggtgtccgccatggcggccagctgcgggaggtgggtcacgcacagcacctgcttgcggcggctgacctgggccagcttctccgccaccttctgggccgcacggccggagacgccggtgtccacctcgtcgaacaccagcgtgccgatggactcctgctccgccagcacatttttcagagccagcatgatccgggccagctcaccgccggaggcgatccgggcgatgggcttcaagtcctccccggcgttggcagacatcagaaaccggacggcgtcacagccgtcggggcccggctccttctccccgaagtcgatggcgaaccggaccttgtgcatgtccaggtcccggagctcggactggatgcgctgctccagaacggcggcggcctctttccgggcggcggtcagctccgcccccgctgccaggacggccttccgggccttctccagctgctgttccagccgggccagggtgtcgtccgccgtctccatatcatccagctcccggcggcacttgtccaggtaggccagcatctcatccaccgtggcgccgtacttctttttcagccggtacagcaggtcggaccggctctccaccgcgtccagctccgccggggagaagtcgaacgcctcccgcttgtcccgaatgatctcggcaaggtcataggcttcacaccgcagctgttccaggcgctggtacagctcccccatgtctccggagagcgtgcggacaccggcgagggcctcttccgcgtcccggagggcggagacggcgccgcctccctcctccccgccgttcaggcagtagtccgcccccgacagggcggagaggtacttctccccgttccgcagcaggtcccgccgctctgtgaggctctcctcctcgccgggcaccagctgggcccgctccagctcgtcgatctgaaagcggaggctgtccatccgccgggccttctccgcctcgtccatctggagagcccgaatcttcgcctgtaagtcggccatggcttcataggtcgtctgataccgccccaggggtgcctccgtccggccaaagcggtccagatagctcaggtgctgctcctcgtccagcagctgctggccgtcgtgctggccgtggatgttcagcagctcttctccgatcctgcgcagctgggccacggtgacagggcggccgttgacccggcagaggttcttgccgtcccccgtcagctcccgctggagcagcaggtggccgtcctcgtccggggcagctccggtctccgccaacccggccagatcaccgggcacctgggaaaattcggcgctgacaaaggcccggtccgcgccggtgcggaccaggtcccgggaggtgcgcccgcccagtaccgcgcccatggcgtcgatgacgatggacttgccggcgccggtctcgccggtgagggcgttgaagccggggcggaactggatgtccgcctcctggatgaccgcgatattctcaatgtgcagaagctccagcatgggactcctcctctgaaaaagcgcccggcaggtccgccgggcgcggcaatgtcagctgatgaacatggcgtcgccaaaggagaagaagcggtatttctcccgcaccgcctcctcataggcggccagcacgtgctcccgcccggcgaaggcggacaccagcatgatgagggtgctctccggcaggtggaagttggtcaccaggccgtccatcaccttgaatcggtagccggggtagatatagatgtccgtccagccggacttggcctccatgtgtccgtcctcggcggcccaggattccaatgtccgacaggaggtggtgcccacacagatgcaccggcccccgcccttccgggtctcgttgatgaggtccgccgtctcctgggggatggtgcagtactcgctgtgcatggggtggtcctcaatggtgtcctccttcacgggccggaaggtgcccaggcccacatggagcgtcacatacccgatctttacgcccttggcccggatcttctccagcagctccggggtgaagtggagccccgccgtgggggcggcggcgctgcccaggaccttggagtacacggtctgataccgctcctggtcctggagctcctccttgatgtaggggggcagaggcatcttgcccagccgctccagcgtctccagaaagatgccctcgtagtcgaagcggatcaggcggccgccctcctccagctgctccacgatctcggcggtcagctccccgttgccgaaggacagtctggtgcccttgcggagcttccggcccgggcggaccagacactcccacaccttgtctcccctgtcgttcagcagcagcacctcgcagatgccgccgccgggcagccgctgtcccaccagacgggcgggcagcacccgggagttgttcaaaatcaggcagtcgccggggttcaggtagtccggcaggtcgtagaaatggtggtgtcccgtggcgccgctcacccgatccagggtcatcaggcgggaggtgtcccgcttctcgatgggggtctgggcgatcagctcctggggcaggtcgtagtaaaaatcactggtcttcatgttgcttccttctcgttaccggacacggatgccggtgaaataaaattccaaaatgtcgatgtagtcgtggccctgctccgccatggccctggcgccgtactggctcatgcccacgttatggccgtttccggtgccggtgatggtgatgccgccccgggaggcggagccccgcccgccggagctgccgccggtgaggtccgccgttccggaggcggagatggcggcgtggtcctccccctctaggcggctgacggtgccgctgccggagatgacggacgcaccgtccagagccgacagggtgccggaggcgctgttcaccgcgtagctgctgccgcccccggtgccgccggtgatggtgaaccgcaggctggggacgttcttgcccagggtggtgctgtaaaaggccatccgggcatcgtcccccgtgcggaccagggtctttccgcggctgtccacaaaggtcacggaatacacgttgcccagatcggtgacttccgatacataggcgtccaccacgtccccgatgtcgtagccgctgttctgcagcacccaggtcagctcctcccaggtataggtgaccgtccacctgtaatcaggaatggagatctgcgcctcgtaggggtcttcctttccccggagatagggcacgtcggtgccccagacgttctccgcgtcctcggtggcgccgccgtcggaggagtggtagtaggcctgggccagctcgccgtcataatagaggcactccccctccgtctcctccaccgcccggtccgtggcggaggtggcctcaccgatgccgctgtacgcttggcagtctgtggagctgcacacgtcgaatccgtaggcggacaggtgcttggtggtgaggcaggcaaaggtccgggcgcacacggcctgggccttcaaggcctccagctcccagttccccggcatttcagagggcagaacgcccttcacatagtcctccaggtccaccacgttcaccacctgcagcccgccgccgctgacggtgtactcgaacccgccccggtagcggttcccccggaaccaggtgacggggtcccggccctggggcatcacggccagggtgtcctccctgctctcatagaggacccggtctgtgccggtgatggtcacctggatgccgtcccggcctgccggctccatggtgatggcggtctcgtccgtctcacccagggacacgaaggtccggtcgtcctcgaagtacccgaactcgtaaccgctgccctcatcgttttccaggttggcggaggacatgacggaggagccgtaccgcagccccaccttcaccgtatcattggtgacggcggaggcgctgacagtacccagggcgtaaaatgtcacaatcagcgacagcaggaacaagccttttttcatggaacctccccaagccatgcaccttgacggaatcgcagaagtatgctaatatatgtacaaatgtccgtgctggaagtacaggctttctacatcaatatggatcattatagtacattccggcgccatattcaaccaaaatcgacggaaggcatcgcgtttttccgccgcaacatgggagcaggaggcacatactatgaaacagtacaaagtcggaatcatcggcggcaccggcatggtgggccagcgcttcatcacgctgatggagcatcacccctggtttcagctgacggccatcgccgccagcgcacgcagcgccggcaaaccttacgccgaggcggtggcgggccgctgggccctggacgtccccatgccggaggaggccaaaaatctggtggtcctggacgcggagcaggacgcggagcggctggcctccatggtggatttctgcttctgcgccgtggacatgaagaaagaggagatccgggccctggaggagaaatacgcgagactggagtgtcccatcgtctccaacaactccgcccaccggtggaccgacgatgtacccatggtagtcccggagatcaacgcggaccatctggcggtgatcgaggcccagcgcaagcgcctgggcacccgccggggcttcatcgccgtgaagagcaactgttcgctccagagctacgtcccggccctgcaccccctgaagaagtacggcctggacaaaatcctggtctgcacctatcaggccatctccggcgccggcaagaccttccagcgctggccggagatggtggataactgcattccctacatcggcggcgaggaggagaagagcgagcaggagccgttgaagctgtggggccgcgtggaggacgggaagatcgtcagggccgacggcccctccatcaccgcccagtgcttccgggtggcctgccaggacggtcacatggccgcggtgtttatgaaattcgcggacggcaaggccccctccatagagcagatcaaggccgactgggccgccttccggggcgtaccccaggagctggaactcccctccgcccccaagcagttcctccactactttgaggagcctgaccggccccagacccggctggaccggaacctggagcacggcatggccgtgtccgtgggccgcctgcggccggacacccagtacgactacaagttcgtgtgcctctcccacaacaccctgcggggcgctgcgggcggcgcggtgctcctggcggagctgctgtgcgccaagggatacatggactgattccatctcatacatccacaaaagagacggcttgccggagttggcaggccgcctcttttatcctcagacctgcatcaaatttaggaattggaaatttgaaatggaggtgttccgccgcaggcggaacgattttaaatttccaagctccaccgggcaccaaaatttctaattccccatttccagctgaaaaggagcgtgtgtacattgaaaaagcctctcttcaccgggtccggtgtggccattgtcacgccctttaccaaagagaccgtggatctccccaccctggggaagctgctggactttcaaatgaaaaacggcaccgacgccatcatcgtctgcggcaccaccggcgaggccagcaccatgagctaccgggagcggatgcggaccatcgagttctgtgtggaccacgtggacgggcggctgccggtgatcgccggcaccggctccaactccacagagaacgccctggccctgtcccgggacgcggagcgggccggggccgacggattgctgctggtgacgccctactacaacaaggccagccaagccgggctcatccgccacttccaggtgatcgccgacggcgtggatgtgccgctgatcctgtacgacgtaccctcccgcaccggcgtcaccatcgcgccggagacgtatgcggagcttgccaagcaccccaacatcaacggcgtcaaggaggcggggggcaatttctccaacattcagaagacccggaacctgtgcccggaggacttctccatctggtccggcaacgatgacgagacagcggccatctgtatgctgggcggcaagggcgtcatctccgtagtggccaacgtcctgccggcggagatgcaccggctgacggagctgtgcctgcggaacgacttcgccgccgccggaaagctgcagctggagctgaaggacttctgcgacgccatgttctgcgacgtgaaccccatccccgtcaaaacggcgctgaacctgctgggctgggacgtgggccccctgcgcctgccgttgtgcgaccccaccgaggccgggctggagaaaatcagggcggccctggaaaagcacgggctgacctccagagtataagccacagccgcccggcgaaagccgggcggctgctgttcggtttatttccgggtactgccgccgtactgctccgaggacaggcgcacctgggcctctccatcaccgatgccggtgatttccaccgtcagcttgttccgcaggtcggcgctctccccttcctggacctggaaagcccggaccagcgtctctccggcggggatgcgaaccatggagaacagctcctggttgatatggcccacggtccaggggcggaagacacgcaccaggatgtcctggtccccctggttctcgatcaccagggcggcatagggcagctccggcatgaagtggaaggtgtacgtcagatccgccccctggagggccacgccgtccacgaaccgccccagataggcggctggatccagcaccgccgggtccacctcggtgaacaccccgcagctgacgccatactccggcacggtgggcgtctccatctgccgctggatgagttcctcccggatgggcgagtcctcttccagcccgtgtccgacgatgacggaggtgccgtcccccacctgaatctccgctttctggttgccgatggcgatgatgcgctccgtgccgtcttcgttctgcgtggtccttctggagaagaactcagcccccgtccagtagatgggctggccgttcccgtccagacggggattgccctccgcatctacggccgcctcagtgccgaaatcaatgcagttcaggtcctcccggtacaccgcgccgtagaccatgtccagcacctccgccgcggtctcggcgctgatgaagtagtggtcctccccgttttcatcagtgtaggtcagcacagtggggatctgcgctccgtcctccgtagtccaggcagcgccggcaggtacctgttccttgccgaacagagccacacccgcctcgccgtaggccacctgtccgttcagcgttccgctctgagggacagcgggcggcctggtctcccccgccagggaggcccccaccagccctaccaacagcagcatggtgctcatgcccgcgataaagggaatgtaattgcgtttcatcagattccttcctttcctgtcaccaggtcacattcctggcaatctccagcagctcttcggcggacaggcccttcccatggagggcgaagatgtagggcccgtccgtccacagcaggtctttttctgtgctgtccgtctcctcttccaccagcaggcccaggcggccgttgacctccacctcagagccctggcaggcggtccccttggaacccaccaggtcctctccctgggtctgcatcagggtgaaggaggcatcctccccccttcggtacgccagacttcgctccccgcggatctcactggtgctgccgcggaccaggatgaagccctccggcacacagcgcagttgggcgtcctggaaaggccgggtggtggtgtgctccaggcggataacgtaccgcagttccccgtctgtctgggaccagtagatctggcagtccgtccggtcccccgcccccacggagagtcccgccgccagggcgcccagcacggcggccgccgccagcagggcccgccagtgccgccgtctccgctgacggcggagcagcgtcgccatccgggcctcgaagtccggggagaagtcatggacgcagtcctcccggtccggcagagcggagaggaatttctccgccgcctccggcgccgccgcgtacagggcctcctctgagatcatcatggcgtctcccccctctcatccagaatttccgccagcttcttccgggcccggtgcaaggtctgggtcacggcatcaggggtggcggagagaaatcccgcgatctcccgggcggaatagccgttgtagtattttagcagaagcacctcccggtaccggggcggcagggatgccatggcatcggccagaccgccgccctccggcggtgcggaccagacggtctgttcatccagctccgtctccggatggcgctggtgggagcgatatagatcgatggccttccgctccgccaccgtcaccaccagattccgcgtccggggacaggggccgtcggggatagtcgccatgtgctccgccagcttcacgaaggactggtgcaccgcgtcctctgcgtcttgtggatttttcaggatgtgataggccacatggtacatgaggccccggtaggccaggtacagcgattcaaacctggtccgatcatccgctgtctccatggttgccagatattccagcatggcgttccctcctgtccctctgctctctatgacgctggagcgggcgcaaatttgacggccggatttgaaaattcatgaaaacaggcgggagtactcccgcctgttctgctatgcagcgcccagctccgcctcctgctgccggaccgaggcctccatggcctccaggctgtccagggacagcagatcgctgaatatataattctgcagctccagccccggaataccagtctggaactccccgttttccgtgctggccaaaaggatgctgtcctggaggagacctcgcagctcccagaaaaacccggcgatggcctccgggtcaaactggtgttcctcccggccaaagttgatgtcaaaggttaccgacctgttgtccgatgtgtatgcctgcccgttcccatcaaaggcccacaattcataggcgtattccgcccagccctggtacatctccggctcgtattgcagcaggtagtcctcgccatcgatcttgcaggcaaatacgctggtccagccggcatgggacggatgggctccggcggaccacaactccacgccgtcctgccggatgacctgcaggatataccaagcgggatagtaatctgtctccggggtgagcaccgtcaccagctccgtggtctccggcatgccgtcgtggtcgaagtcgtagtcctccgacagtacctctgtggtctgttccaaagcggagccagacagcgttccgtcctggttcatacgcacggtgcagcggtaggtgtggggctcccctgcgtccccaccccggccgaccgtcagcaacagggtgtccatgtccggccatgtgccccagtcctccgggagaaattcgtactccgggatggggctgccgtccggcagggtgaagtccaagctgatccagcaggcggtggagatgaccttcacctgggtccaggtccggccgccataggcgatagccaccagattatttgccggagaccaccgcgccgactgccagagcgccccttggtcctgccagagaagttcaccggtctccgtgtccacgatctgcaggaattccggcaccacgtatccgctgacatacatctcactctttcccgctgtccggacctggaaccgcccgttgggggacagggtctctccctccacctgggctaccggtgcggcctccagaggcgcttggtactccgccgtctcctgccgctgtgccgccatttggggggacgccacccccgctgtgaccgccgtgataactgccagtgccaacacgccaaaaatccgccgtttgtccatgaaaaaccaccccgcaagctgttttgcaaacagtttacagggtggttttgcctgatgtcaactacaatccagtaacagctcagccgttcagccgggcaagcatctcctcccgggccccggcgatatacgcatcgtaggtgcacatcttgtcgatgagcttcccgtccacgaactccatgacccggttggcgatggtctggacaaactcatggtcgtggctggcgaagaggaccacgcccttgaagtcgatcaggccgttgttgacggcggtgatggactccaggtccaggtggttggtgggctggtccagcaccagggcattggaaccgaacagcatcatccgggacaacatgcaccggaccttctcgccgccggagaggaccttaacgggcttgtacacgtcgtcgccggagaacagcatccgccccaggaaggaccgcttgaaggactcggtgccctcctccgcgttgtcggcggtgtactggcccagccagtccaccagattcaggtcgcagtcgttgaagaaggcggagttgtccagggggaagtagctggtggtgatggtggtgccccacttgaaggtgcccgcatccggctccagctcctccatcaagatcttgaacagcgtggtggtggcgatctcgtcctcccccacgaaggcgatcttgtcgcccttgttcacccggaagctgacgttgtccagcaccttccggccgtctacggtcttggtaaggccctccaccgccagaatctccttgcccggctcccggtccatcttgaagcccacgaagggatagcgccgggaggaggcgggcatctcctccaccgtcagcttgtccagcagcttccggcgggcggtggcctgcttgctcttggacttgttggcagagaagcgggagacgaactcctggagctccttgatcttctcttccttcttcttgttctggtcccggatcagccgctgcatcatctggctggactcgtaccagaactcgtagttgcccacatacatcttgatcccgccgtagtccacgtccacgatattggtgcacacagtattcaggaagtggcggtcgtggctcaccacgataataaggctctcgcactccaggatgaagtcctccagccactccacggcgtggatgtccaggtggttggtgggctcgtccagcaggatgatgtccggcttgccgaagagggcctgggccagcagcaccttcaccttctccttggcggtcagcgtgctcatctcgctgtacagaatgtcctcggacaatcccaggccctggatcaggcggctcacgtcgctctccgcctcccagccgtccatgtcggcaaactccgcctccagctcgctggccttcacgccgtcggcgtcggtgaagtcctccttggcgtagagggcgtccttctccttcatgatatcgtagagccgctggttgcccatgatgaccgtgtccagcaccgtgtactggtcgtactggaagtggtcctgcttcaaaacgctcatccgctgatccttggagatcaccacctcgccggtggtaggctccagatccccggagaggatccgcaggaaggtggtctttccggcgccgttggcgccgatgatgccgtagcagttgccgggggtgaacttcaggtccacgtgcttgaacagggtctgtccgctgaaattgagactgacgtcattgactgtgatcatagcttgtatcctttttcatatctgcgtatttcatcgcggcagtaggcgcgttttccgcgcctgctgccgctctgtgatccgattagccctcttccgcgatcttgcggcccatgagggtgcccatgacagaggccatcatcaatccccgggtccagccggagctgtcgcccaggcagtggaggccctggaggctggtgttgaagtcggtgtccatcttcacccggttggaatagaacttcagttccggggagtacagcagcgtctcataggcggcgaagcccggcaccacgtagtccatggcttggatgaagttgatgatgttggtcatggcccggtagggcatggcggcggtgatgtcaccggccacggcgtccggcagggtgggccggatgttggactgggccagctccttctgccaggtgcgcttgccatccagaatgtccccgaaccgctggaccaggatctggccgttggccagcatgttggtcagctcgcccaccttctgggcataggcgatgggctggttgaaggggatggagaaattgtgggagcacaggatggagaggttggtgttgtcgctcttcaggtccttgtaggagtggccgttcaccactgccaggttgttgtcgtagttctcctggctgacgaagccgccggggttctggcagaaggtgcggaccttgttcttgaagggcttgggatagcccaccagcttggactcgtacagcacccggttcaccatctccatgacctcgttgcggacctccacccggacgccgatgtccacagtgccgggggcgtgggcgatgttgtgctcggcgcagagcttctccagccagtcggcgccccggcggccggtggccaccacggtatgcttggcgtagatctccaggtccgtcttgccgtcggagatggccacgcccttgcagacctcgttctccaggatcaggttgctgcactcatagccgaagtacatctccaccccgttctcctgtaagtaccgctcgatggcgaggtaaatgccctgggccttctcggtgcccatgtggcggatggggcagtccaccagcttcagccccgcctggatggcccggcggcggatctccttccgctcctcctcgtggcccaggccctcgatgtgctcatccgcgccgaactccaggtagatctggtcggcgtagtcgatggtctcctgggccaggtccgccccgatcagggtgggcaggtcgccgcccacctcatagctgagggagagcttgccgtcggagaaggcgccggcgccggagaagccggtggtgatgtggcagtagggcttgcagttcacgcacttcttggtcttgtccttggggcagtggcgcttttccaccggctgtcccttttccaccatgacgatcttctggcggctgcccttcttaatcatctccaaagcggtgaagataccggcggggccggcgccaacaatgacaacatctgcgttcatagtcttctctcctcgtttttcctcatttggctgacaggtccaccccgcggcgcaccagggaatacggcggcaccgccttgggaaggtccatatagaatttcatctgtggggtgcggggttccaccagggacgcccccgcctcgtcccgcatctccggcacggttatggagaagggccgcagatccgggcccacgatctccaccgtgtccccggcgcggaacttgttccgcagggacagcacggcgtgcccagcgctgtcgcagtccgtcaccaccgccgccacctgccattcccggacatagcgggaggtggcgtaatactggcccggcgggccgtagtaaaagccggtggagtagggccggtggctcacgtgctccacctcgtcccgccacacgggatcgacggactcccctgccgccgcggcgtccaaacagtggcggtaggccccggtgacgatggccgcgtagtaggcggacttggcccggccctcgatcttcaaactggagaggcccgcgccgcacaggtcccccaggtggtcgatcatgcacatgtcccgggagttcaggatataggtgccctgctcgtcctcaaacaccgggaaatactctcccggacgcttctcctccaccagggcgtactggtaccggcagggctgggcacaggcgccccggctggagtcccggccggtcatatagttggagagcaggcaccgccccgagtagctgacgcacatggcgccgtggacgaaggcctcgatctccaggtccgccggggtcttgtcccggatggtgcggatttcctccagactcagctcccgggccaggatcacccggctggcccccaggtcgtgccaggcccgggcggtctcgtagttgcagatgctggcctgggtggagatgtgccgctcacaccggggggcgtacttccccgccatggtaaaggcccccaggtccgccacgatcagggcgtccaccccggcgtccgccagccgttccaggtgctccggcaggcgggccgcctcgtcgttccggggcatggtattgatggtgcagtggacccggacgccgtggctgtgggcaaaggccaccgcctggggcagcgcctcatcggagaagttccccgcaaaggcccgcatcccaaagctggtgcccgccagatacactgcgtccgcgccatagagcacggccattttcagccgctccatgtcccccgccggggccagcagctccggcttgtcccgcttaaccgccataggagctgctgttgacgaacgcgttgtgttccgccagcgtggtggagaagtggtgcttgccgtccgtgcccagggcgtagtaatagtagtccgtgctgttggggttcagcgccgcgtcgatggaggccaggcccgggttggagatgggcgtggggggcaggcccgcgttctggtacaggttgtagggggagtcggtctgcatgtccgcgctggtgatggggccggtgtggtccggcagcgcatagagcagagaggcgtcgatctgcagcaggccgtaggtcccctgcttgttgccggagccctccagccggttgtaaatgacagaggcgatgttggcctgatccgtgccgtcggtctcctcctcgatcagggaggcgatggtgatgatctcctgcagggagtagctggactcctccacctgggtcatccgctcctcgtccatgcggctgacaaagttgcggatcagccggtccagggcgtcctcggcgttatggcccacatagaactcataggtgtccgggaagaggaagccctccagtcggctcaggtcctcggattcgttgtcgatgaagtcgtagtcaaaatcgccggtctgggcggcctcggtcagggcctcctccgtgttgacgcccttttccgccagcagggcgatggtctggcggacggtgtagccctccggaatggtgacggtcaccgtctccgcgctcaggttgccggaggagctgcgcatccccgcgatcagggcgtggtagtccatgtcggtgttcagctcataggtgccgatgcccacctcttcgctggcgccggtgacggccgcgaacaggcggaagaaccacttgtagcggatcagtccggcgtcctgcagcttttccgcgatgctgcccatgtcgtcatccgcggtgatctcaatggtgatcttggtggtggaggggatgtcccggctgaaagcacacaggtcgctggccagcagccagcccacgccagccaggatggccgaggccaccagcacgcacaggatatacaggaccgggttgatccggcggcgcttgcgccgccgccgctgcggctgctgggacggattgccctggctcctccccgtatggcccgcctggctgcggcgcacctgggacgcgtcccagctggcggtatcgccgtttttgtaatcagacataggaacctccattttctcgccccggcggtgcgccgccggaaacgtcccgggatggggaagaaatcttcccctccctgcaatttttttcagcggccaggctccctttggaagccgggcgcatagaatgtctcaaagcgaggtgacaatcatgtgcttcaacaacggaaacaacaattgttcctgcctgtggctcatcatcatcgtcgtgctgatctgctgctgctgtggcagcgggaacgccctcggcggcaatagctgcggctgtggctgcggctgcgggtgcggcaacgacggctgcaacaacggctgctgctgacggctgcggagaaaatggggcgtgttcgtcccattttctttgctcccgtcggggacagcccctagttcagcagcggctccacccgagagagcacctcccggcggatgtcctccattgtccggggcgcgtccccggcggcgcagtcgatcaccgaccagcccagatcccgggcaatctcgcgggcgccctcccggcagcggcggagataagccccgtcctgctcgtgaatgtccgcagcggtggcggtcgcctgctcccgatgccggagcatcttctcagacacctctgtgggcagatccaggtacagcaccaggtccggcgcgggcaggcccatgcggccgtattccaggtcgaagagccagtccagaaatgcctgccgctccccttccgggagcttggatgcctggtggacggcgttggaggtggtgtaccggttggccaccacgatgccgccttcctcatagaacccgccccagtcctccttgtaggaggcgaagcggtccacggcgtacagcaccgacgcggcgtaggcgttcacgtccccgggcctgttgcccagggctccgtggaggtagaggttcgccggttcggcaaaggggttgccataccggggaaagtcgatctcccgatatgcgatgccccgctgggccagggtctcgcacaggagctttgcctgggtggccttgccggagccgtccgtgccctcgaatacaatcagttttccgctcatctgtgtctcttctcctgcttgacatggattaaaaacagcggcagcttcatcatccggccgatgcggcggggctccttgcacaggcggtagaaccactccagcccgtggtcggtccagaattttggggcccgctccaccacgccggcgaatacgtccagactgccccccaggccgcacaacagccgggcgcctgtggcggtgccgttcttcgccatccacttctcctgcttgggggcgcccaggcagacgaacaccacgtccgcgccgctttggcggatggccgctaccaccgggccgtcctccttgaaatagccgtcgtgggtgccggcgatccgcagccccggatgggccgcggccagcttcgctcccgcctgctccgcaacaccgggcttggcgcccaggaggtagagggacttcccttcctccgccagtttatccatcaaatgggtcgcgaattcaacgcccggcgtcctttccttcagaggcgtccccagcatggccgcgcccttgatgacgccgatgccgtccggcagcaccagatccgcgccgttcaccgcggccctggccccgctgtcctcccggcagacctccacgatctccggattgggggtcaccacatagtgggggcccggactgcggaccagctccatcccccgctccacggcctctgccatggtcaggttgtcaaagccgacgcccagcacgtcgatgcgcatggaatcacctcgctacatactcatacaggatagcagtataccacaagccgccgcgtttgtccaaccaaaaatcaacagggacgccaaaaaccggcgtccctgctgaacgattcagttttccggcgccggtaccgcctgctttttccggaagtccggcagctgggccagcaccaccgccgccagcatcagcacgcagcccaggtactccttcccactcatccggtcccccaggatcagcgccccggcgacggtggcgaacacggactccagactcagcagcagggacaccaccgtggggttggagtccttctgcgccaggatctggagggtgtatcccacgccgctggagaagatgcccacatacaggacaggcccgatacaggccagcagccccgcccagtcaggcgtctccatgaccagcatcagtccggcagagagcaccgccatcaccaggaactgtacgcaggacagggccaccccgtccaccttccgggtaaagtggtcgatcagcaggatgtgtccggcgaagcagaaggagcacagcagcacgtaccagtccccctccgtgatggaaaaggactcctgcacgcacagcagatacaatcccaccaccgccagcgccacactgagccagatcgcccggggcgccttttgccggaggaaaatccccgcaatgggcacgatgacaatatagagggccgtgatgaaccccgccttgccggaggtggtggtctccagccccatctgctggaggttggtgcccattgtcaggaccacgccgcagcagataccgccgatggccagatcccgccaggaaccgggccgggcctgggcctcctcctgaaaatcccgccgccgcaggcagcggaacaccagacacagcaccagcagaaacacaaaggccaccgcgcttctggcggcggtgaaggtgaagggacccacatggtcggcggccacgctctgggccacgaaggcggtgccccagatcagagccgccagcacggggaatacattttgacggatgtggttgactttcatcagacttgctcctcaccaggatctatgctatacttttgcaaactcccgtagatttgatgtccgggatcaaaagccgcgaacaaataaaaattttaacacaacggggcggaaatggcaagacccggttcctccccgagaaaaggaggcggcccatgctgctgtttgacatggacgggacgctgatcgactccaacggcgtctggaaaaacgtggaccgggaatttctggcccggcggggcattgcgtacacccacgcctattacgagggcgtagcccataccatccttcccctggccgccaagttcaccaaggagtactgccgcctcacggagtcctgcgaggagatcattgccgagtggatggagatggccagggacgcctatgcccatgtcacggtgaagcccggcgtccgggcgtatttaaagcagtgccgggcagagggccgccggatggcggtggtgacctccagcgtgccggagcactgccgcaccgccctgacccacctggacctgatgaagtactttgagggtgtcactctggcccacgacctggggttggagaaaaaggacccggccctgtggcgtgccgccgcagagcactacggcgtggcaccggaggactgcacggtgttcgatgacagcctctccgcctgcaagggcgccagggctgcaaagatgcgggtggtgggcgtttacgacggtttcttcgcccaggacgaggcggccatgcggggattttgcgacgtgtatatccggagctttgaggagctgctgctcccgccccggcaggcactccgcccatgagcggcctgcctgaggccctggagacggcgcgggaggccggagaggtgctctccgccgcggtcctttcccaggaaaacgccgaggggctggacggctccggcctggacttccgggactgccggttccagtcctgccgcctgcggaactgcgatttcaccggcgcagccttttacggctgcaccttcaccggatgtctcctggagaactgccgcctctccgccacctattggaaggactgccgcctctccggctgcaaatgggacggcgcggacctgcgccgctcccggtggaaggacagcgttctggaggagactctgcttcgttatgtcaacttttccggcggcgtctgggagcgtatttccgtgaaggaatgtgacttcacagagtctacgctctcggagatgcggctgaaaaaagctgccatggagaagacggatctgaccggggcggagctgtttcgcaccagccttgccggcatggacctgacggcctgcaccctggaccggatcgtgctgtcggagacctgccgggagctgaagggcgccgtcatcaacgccgcccaggccgcggtggtggcccggattctgggcatccgggtggagccgtagggggggcatctgtccagccgcaggcatggctgatccccgtgcaatggaccggatctcccacccccgatcacacacaaaacaccagggcccgccgaaaacggcgggccctggtgttcagattgctttctgctggccgatcacgtcccggcaccaggcaaacagccggtccgtgagggctgtcaggtcctcccggcactcccctgctttcagggcctgggcagtttgcagaatctccaggtcctgcccggtcaggtgctgttccaggtctgatctccggcggcagtagagcccctgctctgcatacagcttggcctgcagcaggaacacggcggccttgcaggcctccgccaccgcctcccggcttctgccgtggagaaagttgtggcagcacaggtgatacagtccgcaggccccctgatggagggcccggcgggcgtcccctggctcctccggcggcagcaggtccgcaaggcgtccgcaccagtcggtggtgtcccggcggaactggaacagctccccccggtcccaggccgccagctccgccgtaccggagacgaagccgcacagcttgtcccggtccggcaggtccttcacggctgcccgataggtctccaggtcttgcagagagcagctgtccagaatgcacaccacgtcgatgtcgctgtccggtccggcttctcccctgccccggctgccctggaggccgatgtaccgcacccggtccccaaaggcggcccggacggccccgcagtattgcttcatccagttttcgatctccatcatcacagtttcctcatgtgggctcccgcggatttcagcatcagcttctttttgcccacggtgtcaaaggccacttccgccagggcgtcgccgcccatgggccggacagagagcaccatgcccttcccgaaggcggtatgctccaccatgtccccctgctgtaattgcagcagaggcgccgccggggcggcgttcttccgggtggaggacgcctgctggacagaggccaggggccgctggggcgcctgggccggggcccggtagctgtggacgccgccgctgctccaggagccgccggcgcgggcgggggagctgccccagccgtcctcgtaccggtcgccgccgaaggtgccgtcgtgctccataccgccgaaacggggctccggcttgctctcccagcgcatgttctcctccgggatctcttccaggaaccgggaagcccggttggcgctggtacggccgtacagcatccgctgccggcagttggtgagggtcagcttctccttggcccgggtcatggccacgtagcagagccgccgctcctcctccagctcctcctggtcgtactgggcggaggcgccggggaagatcccctcctccatccccaccacgtacaccaccgggaactccagccccttggcggagtgaatggtcatcatggtgacgcagtcgtcgctggcctccacgctgtccagatctgtgtacagggcaatctcgttcaggaagccggagagggtggcgtcctccggctgctgctccaggaagcccaggatgttggatttcagctcctgaacgttctcgatgcggccccggctctccatgtcgttcttctcctccagggcctttacatagccggtctggtcgcagacggcgtcgtagaactccggcagggccagctccgtgcccgcccgccgcaggccgtcgatcaggtccgcgaacttcagcagcttggcggaagacgctttcagctccgggaacaggtccgcgttgcggatgatctcatacagcgacgccccctggctctccgccaaggcgcccaccttgtccaatgtagtggcgccgatgccccggggcgggttgttgatgatccgccgcagccgcaggtcgtccagggggttgttcagcacgcacagataggccagcatgtccttgacctccgcccggtcgaagaacttcatgccccccactactttataggggatgccgttgcgcttcatggcgtattccagggcgttggactgggcgttcatccggtagaggaccgccgtgtcccggaagttcctgccccggttcacccccatcaggatgtccccggccacgtagttggcctcgtcgctctcgttgaaggtggtcttgaccgtcaccacatcgcccccgccgttgtcggtccagagggtcttgcccttgcggccctggttgttctggatgacggcgttggccgcatccagaatgttctgggtagagcggtagttctgctccaggcgaatggtccgggcggtggggtactgctcttcgaagttcaggatgttttcgatgttggccccccggaagcggtagatggactggtcgtcatcgcccaccacacagaggtttttgtacccccccgccaggaggcttgtcagcagatactgtaagtggttggtgtcctggtactcgtccaccagcacgtagcggaacttgcgctggtagtagtccagcaccgaccgctcctgctgcagtagtgttaccgtgtgaaagatgatgtcgtcaaagtccagggcattggcggtgcggagcttcttcgcataggcggcatagatcttggcgatgcgggtcatcttccagtcccccgccgcctcgtaccgcttggcaaagtcctccggcgtctcatactggtccttggagtggctgatggcggccaggacgctccggggcgggaaggtcttctcctccaggttcagctccttcagaatgtccttgatgacccgcttggagtcgtcggtgtcgtagatggtgaagtccttgtcgaaccccagccggtcgatgtcccgccgcaggatgcgcacacaggcggagtggaaggtggaggcccagatgtcgttggcctccggccccagccgggcggccagccggtccttcagctcccctgccgccttgttggtgaaggtgatggcgatgatctcccagggcttgggcgcgtccagggcgcagagccgccgggcccggcggacgtcctcctccgtgggccgggcggggaagctctccagaaattgaagatcctcttccgtggcccaggccggcacctcttccgaatcgcttccccggccgtaggtgagcaggttgtacacccgctggatcagcaccgtggtcttgccgctgccggcgcccgccagcagcagcagcggaccctccgtggtcatggcagcctggcgctgcatggggttcagcctggataagtcctgggcgatgaccgcccggcgggcggcgatgtagcgttgtttgaagtcttccataagtccaccgttctccatccgtctcaaaagtctcggcccctattttacggcaaaatccccttccggtcaaggcgggaaacggctgttgccggtttgccgcttttgttaccaatttgaggttgacaaatgtctacctatttgatatggtccaatcagaagaccaggtagacactcgtataccatggaggtgagactatgcaggtgaacctgtccgacagcgagtggaagctgatgaaccggctatgggagcagtcccccggaccatcatggagttgacggcctccctgaaggaggacacaggctggagcaagaacacggtgatcaccatgctcgcccggctggaagccaagggggccgtccggcacgaggagggcggccgggccaagcggtacttccccgcggtggaccgcgaggacgccgcggcggcggagacggagagcttcctctcccgggtctacggcggcagcctgggcctgatgatgagcgccatggtggagagccgccagctgacggaggcggacatcgcggagctgtccgctattttggaacgagcgggaggcgaggaac

SEQ ID NO: 11 - DNA, 20 bp, Artificial Sequence
  F480 fwd
tgacaaccagacggcttgtg

SEQ ID NO: 12 - DNA, 22 bp, Artificial Sequence
  F480 rev
gcaggcgaggaaaagatagtgt

SEQ ID NO: 13 - DNA, 22 bp, Artificial Sequence
  ColA1 fwd
cctcagggtattgctggacaac

SEQ ID NO: 14 - DNA, 23 bp, Artificial Sequence
  colA1 rev
accacttgatccagaaggacctt

SEQ ID NO: 15 - DNA, 26 bp, Artificial Sequence
  DEFA fwd
ggtgatcatgagaccccagcatcagt

SEQ ID NO: 16 - DNA, 24 bp, Artificial Sequence
  DEFA rev
aagagactaaaagtgaggagcagc

SEQ ID NO: 17 - DNA, 20 bp, Artificial Sequence
  Dysosmobacter spp fwd
atgacgcatgacgcatgacc

SEQ ID NO: 18 - DNA, 25 bp, Artificial Sequence
  Dysosmobacter spp rev
ccagcgataaaatctttgacatgcc

SEQ ID NO: 19 - DNA, 20 bp, Artificial Sequence
  Total Bacteria fwd
actcctacgggaggcagcag

SEQ ID NO: 20 - DNA, 17 bp, Artificial Sequence
  total bacteria rev
attaccgcggctgctgg
